United States Patent 12,508,308 (INFLUENZA mRNA VACCINES) - sequence listing, part 6

SEQ ID NO: 30805 - RNA, 1698 nt, Artificial Sequence
  hemagglutinin__InfluenzaA__ABA12729
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugaaaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuauaucucuguagugucuucacauuauagcagaagauucaccccagaaauagccaaaagacccaagguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuucagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaagauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30806 - RNA, 1701 nt, Artificial Sequence; identical to SEQ ID NO: 30790
  hemagglutinin__InfluenzaA__ABA12740

SEQ ID NO: 30807 - RNA, 1701 nt, Artificial Sequence
  hemagglutinin__InfluenzaA__ABA12751
augaagacuaucauugcuuugagcuacauucuaugucugguuuucgcucaaaaacuucccggaaaugacaacagcacggcaacgcugugccuugggcaucaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagagauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30808 - RNA, 1701 nt, Artificial Sequence
  hemagglutinin__InfluenzaA__ABA12762
augaagacuaucauugcuuugagcuacauucuaugucugguuuucgcucaaaaauuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30809 - RNA, 1701 nt, Artificial Sequence
  hemagglutinin__InfluenzaA__ABA12773
augaagacuaucauugcuuugagcuacauuuucugucugguucucggccaagauuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcacauauccagugcugaacgugacuaugccaaauaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccaggagacauacugguaauuaacaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 30810 - RNA, 1701 nt, Artificial Sequence
  hemagglutinin__InfluenzaA__ABA12780
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucgaaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuccuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30811 - RNA, 1701 nt, Artificial Sequence
  hemagglutinin__InfluenzaA__ABA16214
augaagacuaucauugcuuugagcuacauuuccugucugguuuucgcccaaaaacuucccggaaaugacaacagcacagcaacgcugugccugggacaucaugcaguaccaaacggaacgcuagugaaaacaaucacgaaugaucagauugaagugacuaaugcuacugagcugguccaaaguuccucaacagguagaauaugcgacaguccucaccgaauccuugauggaaaaaacugcacacugauagaugcucuauugggagacccucauugugauggcuuccaaaaugagaaaugggaucuuuuuguugaacgcagcaaagcuuucagcaacugcuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaaaaguuucuucaguagauugaauugguuguaugagucagaaagcaaauauccagcgcugaacgugacuaugccaaacaauggcaaauuugacaaauuguacauuugggggguucaccacccuagcacggacaaagaacaaaccaaccuauauguucgagcaucagggagagucacagucucuaccaagagaagccagcaaacuguaaucccgaauaucgggccuagacccuggguaaggggucugucuaguagaauaaguaucuauuggacaauaguaaaaccgggagacauacuguuaauuaauagcacugggaaccuaauugcuccccgggguuacuucaaaauacgcacugggaaaagcucaauaaugaggucagaugcaccuauuggcaccugcaguucuggaugcaucacuccaaauggaagcauucccaaugacaaacccuuucaaaaugugaacaagaucacauauggggcaugucccagguauguuaagcagaacacucugaaguuggcaacagggaugcggaauguaccugaaaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaguauguugaagacacuaaaauagaucucuggucuuacaacgcggagcuucuuguugcccuggagaaccaacauacaauugauaugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcucuguguuguuuugcugggguucauaaugugggccugccaaaaaggcaacauuaggugcaacauuugcauuuga

SEQ ID NO: 30812 - RNA, 1701 nt, Artificial Sequence; identical to SEQ ID NO: 30783
  hemagglutinin__InfluenzaA__ABA18026

SEQ ID NO: 30813 - RNA, 1698 nt, Artificial Sequence
  hemagglutinin__InfluenzaA__ABA18037
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugaaggagcaauugaguucaguaucuucauuugagagauucgaaauauuccccaaagggagcucauggcccaaccacaccguaaccggaguaucagcaucaugcucccauaaugggaaaagcaguuuuuacagaaauuugcuauggcugacggggaagaaugguuuguacccaaaccugagcaugucauauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30814 - RNA, 1701 nt, Artificial Sequence; identical to SEQ ID NO: 30764
  hemagglutinin__InfluenzaA__ABA18048

SEQ ID NO: 30815 - RNA, 1701 nt, Artificial Sequence
  hemagglutinin__InfluenzaA__ABA18123
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30816 - RNA, 1701 nt, Artificial Sequence; identical to SEQ ID NO: 30764
  hemagglutinin__InfluenzaA__ABA18134

SEQ ID NO: 30817 - RNA, 1698 nt, Artificial Sequence
  hemagglutinin__InfluenzaA__ABA18145
augaaaguaaaacuacugguucuguuauguacauuuacagcuacauaugcagacacaauauguauaggcuaccaugccaacaacucaaccgauacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagcaauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30818 - RNA, 1701 nt, Artificial Sequence; identical to SEQ ID NO: 30760
  hemagglutinin__InfluenzaA__ABA18156

SEQ ID NO: 30819 - RNA, 1701 nt, Artificial Sequence
  hemagglutinin__InfluenzaA__ABA26700
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguucaucaacagguggaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaccaggaagaaucacagucuccaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugccccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30820 - RNA, 1701 nt, Artificial Sequence
  hemagglutinin__InfluenzaA__ABA26711
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaagucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauaugucgaggacacuaaaauagaucucuggucauacaacgcggagcuucuuguugcccuggagaaccaacauacaauugaucuaacugacucagaaaugaacaaacuguuugaaagaacaaagaagcaauugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30821 - RNA, 1701 nt, Artificial Sequence
  hemagglutinin__InfluenzaA__ABA26722
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccccaacagguggaauaugcgacaguccucaucagauccuugauggagaaaacugcacacuaauagaugcucuauugggagacccucagugugauggcuuccaaaauaagaaaugggaccuuuuugucgaacgcagcaaagcccacagcaacuguuacccuuaugaugugccggauuaugccucccuuaggucacuaguugccucauccggcacacuggaguuuaacaaugaaagcuucaauuggacuggagucacucaaaauggaacaaguucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucuggaugcaucacuccaaauggaagcauucccaaugacaaaccauuucaaaacguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucaaauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30822 - RNA, 1701 nt, Artificial Sequence
  hemagglutinin__InfluenzaA__ABA26733
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30823 - RNA, 1701 nt, Artificial Sequence; identical to SEQ ID NO: 30822
  hemagglutinin__InfluenzaA__ABA26755

SEQ ID NO: 30824 - RNA, 1701 nt, Artificial Sequence
  hemagglutinin__InfluenzaA__ABA26766
augaagacuaucauugcuuugagcuacauucuaugucugguuuucgcucaaaaacuucccggaaaugacaacagcacggcaacacugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30825 - RNA, 1701 nt, Artificial Sequence; identical to SEQ ID NO: 30824
  hemagglutinin__InfluenzaA__ABA26788

SEQ ID NO: 30826 - RNA, 1701 nt, Artificial Sequence
  hemagglutinin__InfluenzaA__ABA26799
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30827 - RNA, 1698 nt, Artificial Sequence
  hemagglutinin__InfluenzaA__ABA42247
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacugggaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30828 - RNA, 1698 nt, Artificial Sequence
  hemagglutinin__InfluenzaA__ABA42258
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaacggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaagggagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30829 - RNA, 1701 nt, Artificial Sequence
  hemagglutinin__InfluenzaA__ABA42269
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcaggauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30830 - RNA, 1698 nt, Artificial Sequence
  hemagglutinin__InfluenzaA__ABA42280
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 30831 - RNA, 1701 nt, Artificial Sequence
  hemagglutinin__InfluenzaA__ABA42291
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucaaaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaacaucggaucuagacccaggguaagggauauccccagcagaauaagcaucuauuggacaauaguaaaaccgggagacauacuuuugauuaacagcacagggaaccuaauugcuccucgggguuacuucaaaauacgaagugggaaaagcucaauaaugagaucagaugcacccauuggcaaaugcaaaucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauaugucgaggacacuaaaacagaucucuggucauacaacgcggagcuucuuguugcccuggagaaccaacauacaauugaucuaacugacucagaaaugaacaaacuguuugaaagaacaaagaagcaacugagagaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30832 - RNA, 1701 nt, Artificial Sequence; identical to SEQ ID NO: 30587
  hemagglutinin__InfluenzaA__ABA42302

SEQ ID NO: 30833 - RNA, 1701 nt, Artificial Sequence
  hemagglutinin__InfluenzaA__ABA42313
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30834 - RNA, 1701 nt, Artificial Sequence
  hemagglutinin__InfluenzaA__ABA42346
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuauagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacagaaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30835 - RNA, 1701 nt, Artificial Sequence
  hemagglutinin__InfluenzaA__ABA42357
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30836 - RNA, 1701 nt, Artificial Sequence
  hemagglutinin__InfluenzaA__ABA42379
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuugugcuuuguauuguuuugcugggguucaucaugugggccugccaaaaaggcaacauuaggugcaacauuugcauuuga

SEQ ID NO: 30837 - RNA, 1701 nt, Artificial Sequence; identical to SEQ ID NO: 30584
  hemagglutinin__InfluenzaA__ABA42390

SEQ ID NO: 30838 - RNA, 1701 nt, Artificial Sequence
  hemagglutinin__InfluenzaA__ABA42401
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccagauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaaucaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucuaaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30839 - RNA, 1701 nt, Artificial Sequence
  hemagglutinin__InfluenzaA__ABA42412
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaguggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30840 - RNA, 1701 nt, Artificial Sequence
  hemagglutinin__InfluenzaA__ABA42443
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaaggagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30841 - RNA, 1701 nt, Artificial Sequence
  hemagglutinin__InfluenzaA__ABA42454
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuauguuucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30842 - RNA, 1701 nt, Artificial Sequence
  hemagglutinin__InfluenzaA__ABA42465
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagucuauaugcucaagcaucagggagagucacagucucuaccaaaagaagccaacaaacuguaaucccgaauaucggaucuagacccuggggaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30843 - RNA, 1701 nt, Artificial Sequence
  hemagglutinin__InfluenzaA__ABA42476
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagaaacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30844 - RNA, 1701 nt, Artificial Sequence
  hemagglutinin__InfluenzaA__ABA42498
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30845 - RNA, 1701 nt, Artificial Sequence
  hemagglutinin__InfluenzaA__ABA42509
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagucuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30846 - RNA, 1701 nt, Artificial Sequence
  hemagglutinin__InfluenzaA__ABA42520
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugacuacauugaagugacuaaugcuacugagcugguucagaguuccucaacagguagaauaugugacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30847 - RNA, 1701 nt, Artificial Sequence
  hemagglutinin__InfluenzaA__ABA42531
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaggugacuaaugcuacugagcugguucagaguuccucaacagguagaauaugcgacaguccucaccaaauccuugauggagaaaacugcacacuaauagaugcucuauugggagacccucacugugauggcuuccaaaauaaggaaugggaccuuuuuguugaacgcagcacagccuacagcaacuguuaccuuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30848 - RNA, 1701 nt, Artificial Sequence
  hemagglutinin__InfluenzaA__ABA42542
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaccuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30849 - RNA, 1701 nt, Artificial Sequence
  hemagglutinin__InfluenzaA__ABA42553
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagcccacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaaggcguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30850 - RNA, 1701 nt, Artificial Sequence
  hemagglutinin__InfluenzaA__ABA42564
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccagaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30851 - RNA, 1701 nt, Artificial Sequence
  hemagglutinin__InfluenzaA__ABA42928
augaagacuaucauugcuuugagcuacauucuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccagaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaauggugaacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30852 - RNA, 1701 nt, Artificial Sequence; identical to SEQ ID NO: 30850
  hemagglutinin__InfluenzaA__ABA42939

SEQ ID NO: 30853 - RNA, 1701 nt, Artificial Sequence
  hemagglutinin__InfluenzaA__ABA42978
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuauuccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30854 - RNA, 1701 nt, Artificial Sequence
  hemagglutinin__InfluenzaA__ABA43167
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagguugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30855 - RNA, 1701 nt, Artificial Sequence
  hemagglutinin__InfluenzaA__ABA43178
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggcauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagauugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguauugcuuuguugggguucaucaugugggccugccaaaaaggcaacauuaggugcaacauuugcauuuga

SEQ ID NO: 30856 - RNA, 1698 nt, Artificial Sequence
  hemagglutinin__InfluenzaA__ABA43189
augaaagcaaaacuacugguccuguuauguacauuuacagcuacauacgcagacacaauauguguaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaagggagcucauggcccaaccacaccguaaccggaguaucagcaucaugcucccauaaugggaaaagcaguuuuuacagaaauuugcuauggcugacggggaagaaugguuuguacccaaaccugagcaugucauauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30857 - RNA, 1701 nt, Artificial Sequence
  hemagglutinin__InfluenzaA__ABA43200
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguuguccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30858 - RNA, 1701 nt, Artificial Sequence
  hemagglutinin__InfluenzaA__ABA43336
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugaguugguucagaauuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucaguuaacaguuucuucaguagauugaauugguugcacgaaucagaauacaaauauccagcgcugaacgugacuaugccaaacaauggcaaauuugacaaauuguacguuugggggguucaccacccgaucacggacagagaacaaaccaaacuauauguucgagcaucagggagagucacagucucuaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucaccccaaauggaagcauucccaaugacaaacccuuucaaaauguaaacaggaucacauauggggcaugucccagauauguuaagcaaaacacucugaaauuggcaacagggaugcggaauguaccagaaaaacaaacuaggggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaagaaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaaggaguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30859 - RNA, 1707 nt, Artificial Sequence
  hemagglutinin__InfluenzaA__ABA54915
auggagaaaguagugcuucuucuugcaacagccagucuuguuaaaagugaucagauuugcauugguuaccaugcaaacaacucgacagagcagguugacacaauaauggaaaagaacguuacuguuacacaugcccaagacauacuggaaaagacacacaacgggaaacucugcgaucuagauggagugaagccucuaauuuugagagauuguaguguagcuggauggcuccucggaaauccuaugugugacgaauucaucaaugugccggaauggucuuacauaguggagaaggccaguccagccaaugaccucuguuacccaggggauuucaacgacuaugaagaacugaaacaccuauugagcagaauaaaccacuuugagaaaauucagaucauccccaaaaguucuugguccaaucaugaagccucaucaggggugagcgcagcauguccauaccaugggaagcccuccuuuuucagaaaugugguauggcuuaucaaaaagaacagugcauacccaacaauaaagaggagcuacaauaauaccaaccaagaagaucuuuugguacugugggggauucaccauccuaaugaugcggcagagcagacaaagcucuaucaaaacccaaccaccuauauuuccguuggaacaucaacacuaaaccagagauuggucccaaaaauagcuacuagauccaaaguaaacggacaaaguggaagaauggaguucuucuggacaauuuuaaagccgaaugaugccauaaauuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccccucacaaucggggaaugccccaaauaugugaaaucaaacagauuaguccuugcgacuggacucagaaauaccccucaaagagagagaagaagaaaaaagagaggacuauuuggagcuauagcagguuuuauagagggaggauggcaaggaaugguagaugguugguauggauaccaccauagcaaugagcaggggaguggauacgcugcagacaaagaauccacucaaaaggcaauagauggagucaccaauaaggucaacucgaucauugacaaaaugaacacucaguuugaggccguuggaagggaauuuaauaauuuagaaaggaggauagaaaauuuaaacaagaagauggaagacggauuccuagaugucuggacuuauaaugcugaacuucugguucucauggaaaaugagagaacucuagacuuucaugacucaaaugucaagaaccuuuacaacaagguccgacuacagcuuagggauaaugcaaaggagcuggguaaugguuguuucgaguucuaucacaaaugugauaaugaauguauggaaaguguaaaaaacgggacguaugacuacccgcaguauucagaagaagcaagacuaaacagagaggaaauaaguggaguaaaauuggaaucaaugggaacuuaccaaauacugucaauuuauucaacaguggcgaguucccuagcacuggcaaucaugguagcuggucuaucuuuauggaugugcuccaaugggucguuacaaugcagaauuugcauuuaa

SEQ ID NO: 30860 - RNA, 1698 nt, Artificial Sequence
  hemagglutinin__InfluenzaA__ABA87080
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuauagaaacaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacaugggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuugaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30861 - RNA, 1698 nt, Artificial Sequence
  hemagglutinin__InfluenzaA__ABA87091
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagagaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30862 - RNA, 1698 nt, Artificial Sequence
  hemagglutinin__InfluenzaA__ABA87231
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaaccccgaaugcgaauuacugauuuccaaggaaucaugguccuacauuguagaaacaccaaaucccgagaauggaacauguuacccaggguauuucgccgacuaugaggaauugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagagaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30863 - RNA, 1701 nt, Artificial Sequence
  hemagglutinin__InfluenzaA__ABA87242
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuuggggaguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30864 - RNA, 1701 nt, Artificial Sequence; identical to SEQ ID NO: 30783
  hemagglutinin__InfluenzaA__ABA87253

SEQ ID NO: 30865 - RNA, 1698 nt, Artificial Sequence
  hemagglutinin__InfluenzaA__ABB02781
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaguaugcaucuga

SEQ ID NO: 30866 - RNA, 1698 nt, Artificial Sequence; identical to SEQ ID NO: 30805
  hemagglutinin__InfluenzaA__ABB02792

SEQ ID NO: 30867 - RNA, 1698 nt, Artificial Sequence
  hemagglutinin__InfluenzaA__ABB02803
augaaaguaaaacuacugguucuguuauguacauuuacagcuacauaugcagacacaauauguauaggcuaccaugccaacaacucaaccgauacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucucccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30868 - RNA, 1698 nt, Artificial Sequence
  hemagglutinin__InfluenzaA__ABB02814
augaaagcaaaacuacugguccuguuauguacauuuacagcuacauacgcagacacaauauguauaggcuaccaugccaacaacucaacagacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaagugugacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30869 - RNA, 1698 nt, Artificial Sequence
  hemagglutinin__InfluenzaA__ABB02825
augaaagcaaaacuacugguccuguuauguacauuuacagcuacauacgcagacacaauauguauaggcuaccaugccaacaacucaacagacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugcgaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaagugugacaaugaaugcauggaaagugugaaaaauggaacuuaugacuauccaaaauauuccgaagaaucaaaguuaaacagggagagaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30870 - RNA, 1701 nt, Artificial Sequence
  hemagglutinin__InfluenzaA__ABB02836
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaaaccaacaaacuguaaucccgaacaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaagucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauaugucgaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30871 - RNA, 1701 nt, Artificial Sequence
  hemagglutinin__InfluenzaA__ABB02847
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggauuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 30872 - RNA, 1701 nt, Artificial Sequence
  hemagglutinin__InfluenzaA__ABB02858
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggguacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30873 - RNA, 1701 nt, Artificial Sequence
  hemagglutinin__InfluenzaA__ABB02869
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucguagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30874 - RNA, 1701 nt, Artificial Sequence
  hemagglutinin__InfluenzaA__ABB02880
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacaggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30875 - RNA, 1701 nt, Artificial Sequence
  hemagglutinin__InfluenzaA__ABB02891
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcgaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30876 - RNA, 1701 nt, Artificial Sequence
  hemagglutinin__InfluenzaA__ABB02902
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30877 - RNA, 1698 nt, Artificial Sequence
  hemagglutinin__InfluenzaA__ABB02913
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaucugagcauguccuauguaaacaacaaagagaaagaaguccuugugcuaugggguguucaucgcccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacaggauuacaaacaaggugaauucuguaauugagaaaaugaacacucaauucacagcugugggcaaagaauucaacaaauuagaaagaaggauggaaaacuuaaauaaaaagguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccgaaauauuccgaagaaucaaaguuaaacagggagaaaauugauggaguaaaauuggaaucaaugggagucuaucagauucuggcgaucuacucaacugucgcuaguucccugguucuuuuggucucccugggggcaaucagcuucuggauguguuccaaugggucuuugcaguguagaauaugcaucuga

SEQ ID NO: 30878 - RNA, 1698 nt, Artificial Sequence
  hemagglutinin__InfluenzaA__ABB02924
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaacgggauuacaaacaaggugaaugcuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuga

SEQ ID NO: 30879 - RNA, 1698 nt, Artificial Sequence
  hemagglutinin__InfluenzaA__ABB02936
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccagggcauuucgccgacuaugaggaacugagggagcaauugaguucaguaucuucauuugagagauucgaaauauuccccaaagggagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30880 - RNA, 1701 nt, Artificial Sequence
  hemagglutinin__InfluenzaA__ABB02947
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugcaggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucagaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30881 - RNA, 1701 nt, Artificial Sequence; identical to SEQ ID NO: 30694
  hemagglutinin__InfluenzaA__ABB02958

SEQ ID NO: 30882 - RNA, 1701 nt, Artificial Sequence; identical to SEQ ID NO: 30694
  hemagglutinin__InfluenzaA__ABB02969

SEQ ID NO: 30883 - RNA, 1701 nt, Artificial Sequence
  hemagglutinin__InfluenzaA__ABB02980
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugaggguacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30884 - RNA, 1701 nt, Artificial Sequence
  hemagglutinin__InfluenzaA__ABB02991
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaauccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30885 - RNA, 1701 nt, Artificial Sequence
  hemagglutinin__InfluenzaA__ABB03002
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcaacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguucaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30886 - RNA, 1701 nt, Artificial Sequence
  hemagglutinin__InfluenzaA__ABB03013
augaagacuaucauugcuuugagcuacauuuuaugccugguuuucgcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccggguacggacagugaccaaaccagccuauaugcucaagcaucagggagagucacagucucuaccaaaagaagccaacaaacuguaaucccgaauaucggaucuggacccuggguaagggguguuuccagcagaauaagcaucuauuggacaauagugaaaccgggagacauacuucugaucaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucacagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaaaggcaacauuaggugcaacauuugcauuuga

SEQ ID NO: 30887 - RNA, 1701 nt, Artificial Sequence
  hemagglutinin__InfluenzaA__ABB03024
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguucaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggauaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaauuaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30888 - RNA, 1701 nt, Artificial Sequence
  hemagglutinin__InfluenzaA__ABB03035
augaagacuaucauugcuuugagcuacauuuuaugccugguuuucgcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacguggcuaugccaaacaaugacaaauuugacaaauuguacauuugggggguucaccacccggguacggacagugaccaaaccagccuauaugcucaagcaucagggagagucacagucucuaccaaaagaagccaacaaacuguaaucccgaauaucggaucuagacccuggguaagggguguuuccagcagaauaagcaucuauuggacaauagugaaaccgggagacauacuucugaucaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucacagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccacaucauguuuuuugcuuuguguuguuuugcugggguucaucaugugggccugccaaaagggcaacauuaggugcaacauuugcauuuga

SEQ ID NO: 30889 - RNA, 1701 nt, Artificial Sequence
  hemagglutinin__InfluenzaA__ABB03046
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcggaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 30890 - RNA, 1701 nt, Artificial Sequence
  hemagglutinin__InfluenzaA__ABB03057
augaagacuaucauugcuuugagcuacauucuaugucugguuuucgcucaagaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacaggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaccagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuuuaggcaucaaaauucugagggaauaggacaagcagcagaucucaaaagcacucaagcagcaaucaaccaaaucaaugggaagcugaauagguugaucggaaaaaccaacgaaaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguucgaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaaguuaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30891 - RNA, 1701 nt, Artificial Sequence
  hemagglutinin__InfluenzaA__ABB03068
augaagacuaucauugcuuugagcuacauucuaugucugguuuucgcucaagaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaccagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuuuagacaucaaaauucugagggaauaggacaagcagcagaucucaaaagcacucaagcagcaaucaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguucgaaagaacaaagaagcaacugagggaaaaugcugaggauaugggcaaugguugcuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30892 - RNA, 1701 nt, Artificial Sequence
  hemagglutinin__InfluenzaA__ABB03079
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaauugcggguuucauagaaaaugguugggagggaaugguugaugguugguacgguuucaggcaucaaaauucugagggaauaggacaagcagcagaucucaaaagcacucaagcagcaaucaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30893 - RNA, 1701 nt, Artificial Sequence
  hemagglutinin__InfluenzaA__ABB03090
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugaccaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauagggcaagcagcagaucucaaaagcacucaagcagcaauaaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30894 - RNA, 1698 nt, Artificial Sequence
  hemagglutinin__InfluenzaA__ABB03101
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaaaaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugagacaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 30895 - RNA, 1701 nt, Artificial Sequence
  hemagglutinin__InfluenzaA__ABB03112
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaagaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaauaccugcauagagucaaucagaaauggaacuuaugaccaugauguauacagagaugaagcauuaaacaaccgguuccagaucaaagguguugagcugaagucaggauacaaagauuggauucuauggauuuccuuugccauaucauguuuuuugcuuuguguugcuuuguugggguucaucaugugggccugccaaaaaggcaacauuaggugcaacauuugcauuuga

SEQ ID NO: 30896 - RNA, 1698 nt, Artificial Sequence
  hemagglutinin__InfluenzaA__ABB03123
augaaaguaaaacuacugguucuguuauguacauuuacagcuacauaugcagacacaauauguauaggguaccaugccaacaacucaaccgacacuguugacacaguacuugagaagaaugugacagugacacacuuugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagagagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30897 - RNA, 1698 nt, Artificial Sequence
  hemagglutinin__InfluenzaA__ABB03134
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccccuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggagaagaaugguuuguacccaacccugagcaaguccuaugcaaacaacaaagagaaagaaguccuuauacuaugggguguucaucacccgccuaacauaggggaccaaaggacccucuaucauacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagacgggugguaugguuaucaucaucagaaugagcaaggaucuggcuaugcugcagaucaaaaaagcacacaaaacgccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccacgacuccaaugugaagaaucuguaugagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaaucgauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30898 - RNA, 1698 nt, Artificial Sequence
  hemagglutinin__InfluenzaA__ABB03145
augaaagugaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaccacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguggaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30899 - RNA, 1701 nt, Artificial Sequence
  hemagglutinin__InfluenzaA__ABB04283
augaagacuaucauugcuuugagcuacauuuucugucugguuuucgcccaaaaccuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggggucacucagagugggggaagcuaugcuugcaaaaggggaucugauaaaaguuucuucaguagacugaacugguuguacgaaucagaaagcaaauauccagcgcugaacgugacuaugccaaacaauggcaauuuugacaaacuguacauuugggggguucaucacccgagcacggacaaagaacaaaccaaccuauauguucgagcaucagggagagucacagucucuaccaagagaagccagcaaacuauaaucccgaauaucgggccuagacccuggguaaggggccugucuaguagaauaaguaucuauuggacaauaguaaaaccgggagacauacuguuaauuaauaguagugggaaccuaauugcuccucgggguuauuucaaaauacgcacuggaaaaagcucaauaaugaggucagaugcaccuauuggcaccugcaguucugaaugcaucacuccaaauggaagcauucccaaugacaagcccuuccaaaacguaaacaagaucacauauggggcaugucccaaguauguuaagcaaaacacucugaaauuggcaacagggaugcggaauauaccagagaaacaaacuagaggcauauucggcgcaauagcagguuucauagaaaaugguugggagggaaugguagacggcugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 30900 - RNA, 1701 nt, Artificial Sequence
  hemagglutinin__InfluenzaA__ABB04294
augaagacuaucauugcuuugagcuacauuuucugucugguucucggccaagaccuuccagggaaugacaacagcacagcaacgcugugccugggacaucaugcggugccaaacggaacgcuagugaaaacaaucacgaaugaucagauugaagugacuaaugcuacugagcugguucagaguuccucaacggguaaaauaugcaacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacucugaaguuggcaacaggaaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauauguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 30901 - RNA, 1701 nt, Artificial Sequence
  hemagglutinin__InfluenzaA__ABB04305
augaagacuaucauugcuuugagcuacauuuucugucugguuuucgcccaaaaacuucccgaaaaugacaacagcacagcaacgcugugcuugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacaaaucagaaagcaaauauccagugcugaacgugacuaugccaaauaauggcaaauuugacaaauuguacauuugggggguucaccacccgagcacggacaaagaacaaaccaaccuauauguucgagcaucagggaaagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacuggaaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggagcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaacagguuaaucgagaaaacgaacgagaaguuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugauucagaaaugaacaaacuguuugaaaaaacaaggaaacaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30902 - RNA, 1701 nt, Artificial Sequence
  hemagglutinin__InfluenzaA__ABB04316
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacauugauagaugcucuauugggagacccucauugugauggcuuccaaaaugagaaaugggaccuuuuuguugaacgcagcaaagcuuacagcaacuguuacccuuaugaugugccggauuaugcuucccuuagaucacuaguugccucaucaggcacccuggaguuuaucaaugaagacuucaauuggacuggagucacucagagugggggaagcuaugcuugcaaaaggggaucuguuaaaaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaagagaagccagcaaacuguaaucccgaauaucgggucuagacccuggguaaggggccuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucaucgaaaaugguugggagggaaugguagacgguugguacgguuucaggcaucaaaauucugaaggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaaaacuggauccuauggauuuccuuugccauaucaugcuuuuugcuuuguguuguuuugcugggguucaucaugugggccugccaaaaaggcaacauuaggugcaacauuugcauuuga

SEQ ID NO: 30903 - RNA, 1701 nt, Artificial Sequence
  hemagglutinin__InfluenzaA__ABB04327
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagcgggggaagcuaugcuugcaaaaggggaucuguuaacaguuucuucaguagauugaauugguuguacaaaucagaauacaaauauccagcgcugaacgugacuaugccaaacaauggcaaauuugacaaauuguacauuugggggguucaccacccgagcacggaaaaagaacaaaccaaccuauauguucgagcaucagggagagucacagucucuaccaagagaagccagcaaacuguaaucccgaauaucgggucuauacccuggguaaggggucuguccaguagaauaagcaucuauuggacaauaguaaaaccgggagacauacuguugauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30904 - RNA, 1701 nt, Artificial Sequence
  hemagglutinin__InfluenzaA__ABB04338
augaagacuaucauugcuuugagcuacauuuucugucugguucucggccaagacuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccaggagacauacugguacuuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgaaaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuuacugggguucaucaugugggccugccagaaaggcaacauuaggugcaacauuugcauuuga

SEQ ID NO: 30905 - RNA, 1701 nt, Artificial Sequence
  hemagglutinin__InfluenzaA__ABB04349
augaagacuaucauugcuuugagcuacauuuucugucugguuuucgcccaaaaacuucccggaaaugacaacagcacagcaacgcugugcuugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcaccuuggaguuuaucaaugaaggcuucaauuggacuggagucacucagagugggggaagcuaugcuugcaaaaggggaucuguuaacaguuucuucaguagauugaauugguuguacaaaucagaaagcaaauauccagugcugaacgugacuaugccaaauaauggcaaauuugacaaauuguacauuugggggguucaccacccgagcacggacaaagaacaaaccaaccuauauguucgagcaucagggaaagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacuggaaaccuaauugcuccucgggguuacuucaaaauacgcacugggaaaagcucaauaaugaggucagaugcaccuauuggcaccugcaauucugaaugcaucacuccaaauggaagcauucccaaugacaaacccuuucaaaauguaaacaagaucacauauggagcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaacagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugauucagaaaugaacaaacuguuugaaaaaacaaggaaacaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30906 - RNA, 1701 nt, Artificial Sequence
  hemagglutinin__InfluenzaA__ABB04360
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguugcacaaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcagcucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacuaaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggaucuuauggauuuccuuugccauaucaugcuuuuugcuuuguguuguuuugcugggguucaucaugugggccugccaaaaaggcaacauuaggugcaacauuugcauuuga

SEQ ID NO: 30907 - RNA, 1701 nt, Artificial Sequence
  hemagglutinin__InfluenzaA__ABB04371
augaagaccaucauugcuuugagcuacauuuucuaucuggcucucggccaagaccuuccaggaaaugacaacagcaaagcaacgcugugccugggacaucaugcggugccaaacggaacacuagugaaaacaaucacagaugaucagacugaagugacuaaugcuacugagcuaguucagagcuccucaacggggaaaauaugcaacaauccucaucgaauccuugauggaauggacugcacacugauagaugcucuauugggggacccucauugugauguuuuucaaaaugagacaugggaccuuuucguugaacgcagcaaagcuuucagcaacuguuacccuuaugaugugccagauuaugccucccuuagaucacuaguugccucgucaggcacuauggaguuuaucacugaggguuucacuuggacugaggucacucagaaugggggaagcaaugcuugcaaaaggggaccugauagcgguuuuuucaguagacugaacugguugaccaaaucaggaagaacauauccagugcugaacgugacuaugccaaacaaugacaauuuugacaaacuauacauuugggggguucaccacccgagcacggaccaagaacaaaccaaccuguauguucaaacaucagggagagucacagucucuaccaggagaagccagcaaacuauaaucccgaauaucggauccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugauaaacccuuucaaaacguaaacaagaucacauauggagcaugccccaaauauguuaagcaaaacacccugaaguuggcaacaggaaugcggaauguaccagagaaacagacuagaggccuauucggcgcaauagcaggcuucauagaaaaugguugggagggaaugauagacgguugguacgguuucaggcaucaaaauucugagggcacaggacaagcagcagaucuuaaaagcacucaagcagccauugaccaaaucaaugggaaauugaacaggauaaucgagaagacgaacgagaaauuccaucaaauagaaaaggaauucucagaaguagaagggagaauucaggaccucgagaaauacguugaagacacuaaaauagaucuauggucuuacaaugcagagcuucuuguugcucuggagaaucaacauacaauugaucugacugacucggaaaugaacaaacuguuugaaaaaacaagaaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaacagguuucaaaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 30908 - RNA, 1701 nt, Artificial Sequence
  hemagglutinin__InfluenzaA__ABB04906
augaagacuaucauugcuuugagcuacauuuuaugucugguuuucgcccaaaaacuucccggaaaugacaacagcacagcaacgcugugccuggggcaucaugcagugccaaacggaacucuagugaaaacaaucacgaaugaucaaauugaagugacuaaugcuacugagcugguucagaguuccucaacagguagaauaugcgacaguccucaccgaauccucgauggaaaaaacugcacacugauagaugcucuauugggagacccucauugugauggcuuccaaaauaaggaaugggaccuuuuuguugaacgcagcaaagcuuacagcaauuguuacccuuaugaugugccagauuaugccucccuuaggucacuaguugccucaucaggcacccuggaguuuaucaaugaagacuuuaauuggacuggagucgcucagaauggggacagcuaugcuugcaaaaggggaucuguuaaaaguuucuuuaguagauugaauugguugcacaaaucagaauacaaauauccagcgcugaacgugacuaugccaaacaaugacaaauuugacaaguuguacauuugggggguucaccacccgagcacggacagagaacaaaccagccuauauauucgagcaucagggaaagucacagucucuaccaaaagaagccaacaaacuguaaucccgaauaucggguccagacccuggguaaggggucuguccaguagaauaagcaucuauuggacaauaguaaaaccgggagacauacuuuugauuaauagcaccgggaaucuaauugcuccucgggguuacuucaaaauacggacugggaaaagcucgauaaugaggucagaugcacccauuggcaccugcaguucugaaugcaucacuccaaauggaagcauccccaaugacaaaccuuuucaaaauguaaacaggaucacauauggggcaugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugaaggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 30909 - RNA, 1701 nt, Artificial Sequence
  hemagglutinin__InfluenzaA__ABB04917
augaagacuaucauugcuuugagcuacauuuucugucugguuuucgcccaaaaacuucccggaaaugacaacagcacagcaacgcugugcuugggacaucaugcagugccaaacggaacgcuagugaaaacaaucacgaaugaucagauugaagugacuaaugcuacugagcugguucagauuuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuauacuugcaaaaggggaucuguuaacaguuucuucaguagauugaauugguuguacgaaucagaaagcaaauauccagugcugaacgugacuaugccaaacaauggcaaauuugacaaauuguacauuugggggguucaccacccgagcacggacaaagaacaaaccaaccuauauguucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacugggaaccuaauugcuccucgggguuacuucaaaauacgcacugggaaaagcucaauaaugaggucagaugcaccuauuggcaccugcaguucugaaugcaucacuccaaauggaaguauucccaaugacaaacccuuucaaaauguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugauucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30910 - RNA, 1701 nt, Artificial Sequence
  hemagglutinin__InfluenzaA__ABB04928
augaagacuaucauugcuuugagcuacauuuucugucugguuuucgcccaagaccuuccaggaaaugacaacagcacagcaacgcugugccugggacaucaugcggugccaaacggaacgcuagugaaaacaaucacgaaugaucagauugaagugacuaaugcuacugagcugguucagaguuccucaacggguaaaauaugcaacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggauuggggucacucagaaugggggaagcaaugcuugcaaaaggggaacugauagcgguuuuuucaguagacugaacugguuguacaaaucaggaagcacauauccagugcagaacgugaccaugccaaacaaugacaauucugacaaacuauacauuugggggguucaccacccgagcacggacaaagaacaaaccgaucuauauguucaagcaucagggaaagucacagucuccaccaagagaagccagcaaacuauaaucccgaaugucgggucuagacccuggguaaggggucugucuaguagaauaagcaucuauuggacaauaguuaaaccgggagacauacugguaauuaauaguaaugggaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacagacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcagagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 30911 - RNA, 1701 nt, Artificial Sequence
  hemagglutinin__InfluenzaA__ABB04939
augaagacuaucauugcuuugagcuacauuuucugucugguuuucgcccaaaaacuucccggaaaugacaacagcacagcaacgcugugcuugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuauacuugcaaaaggggaucuguuaacaguuucuucaguagauugaauugguuguacgaaucagaaagcaaauauccagugcugaacgugacuaugccaaacaauggcaaauuugacaaauuguacauuugggggguucaccacccgagcacggacaaagaacaaaccaaccuauauguucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaauagcauugggaaccuaauugcuccucgggguuacuucaaaauacgcacugggaaaagcucaauaaugaggucagaugcaccuauuggcaucugcaguucugaaugcaucacuccaaauggaagcauucccaaugacaaacccuuucaaaauguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcagucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugauucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30912 - RNA, 1701 nt, Artificial Sequence
  hemagglutinin__InfluenzaA__ABB04950
augaagacuaucauugcuuugagcuacauuuucugucugguuuucgcccaaaaacuucccggaaaugacaacagcacagcaacgcugugcuugggacaucaugcagugccaaacggaacgcuagugaaaacaaucacgaaugaucagauugaggugacuaaugcuacugagcugguucagagcuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuauacuugcaaaaggggaucuguuaacaguuucuucaguagauugaauugguuguacgaaucagaaagcaaauauccagugcugaacgugacuaugccaaauaauggcaaauuugacaaauuguacauuugggggguucaccacccgagcacggacaaagaacaaaccaaccuauauguucgagcaucagggaaagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacuggaaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggagcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaacagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugauucagaaaugaacaaacuguuugaaaaaacaaggaaacaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30913 - RNA, 1701 nt, Artificial Sequence
  hemagglutinin__InfluenzaA__ABB04983
augaagacuaucauugcuuugagcuacauuuuaugucugguuuucgcucaaaaacuucccggaaaugacaacagcacggcaacacugugccuggggcaccaugcagugccaaacggaacgcuagugaaaacaaucacgaaugaccaaauugaagugacuaaugcuacugagcugguucagaguuccucaacagauagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagcuuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 30914 - RNA, 1701 nt, Artificial Sequence
  hemagglutinin__InfluenzaA__ABB04994
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccagaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30915 - RNA, 1701 nt, Artificial Sequence
  hemagglutinin__InfluenzaA__ABB05005
augaagacuaucauugcuuugagccacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccggauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcguucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30916 - RNA, 1701 nt, Artificial Sequence
  hemagglutinin__InfluenzaA__ABB05183
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaacacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaguauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30917 - RNA, 1701 nt, Artificial Sequence
  hemagglutinin__InfluenzaA__ABB05194
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuucguugaacgcagcaaagccuacagcaacuguuacccuuaugaugugccggauuaugccucucuuaggucacuaguugccucauccggcacacuggaguuuaacaaugaaagcuucaauuggacuggagucgcucagaauggaacaagcucugcuugcaaaaggaggucuaauaaaaguuucuuuaguagauugaauugguugcaccaauugaaauacaaauacccagcacugaacgugauuaugccaaacaaugaaaaauuugacaaauuguacauuugggggguucaccacccgaguacggacagugaccaaaucagccuauaugcucaagcaucagggagagucacagucucuaccaaaagaagccaacagacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaguaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucagaaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaauggcuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30918 - RNA, 1701 nt, Artificial Sequence
  hemagglutinin__InfluenzaA__ABB05205
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaacgccuacagcaacuguuacccuuaugaugugccggauuaugccucccuuaggucacuaguugccucauccggcacacuggaauuuaacagugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccggguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauaacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaagcugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacacacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30919 - RNA, 1701 nt, Artificial Sequence
  hemagglutinin__InfluenzaA__ABB05216
augaagacuaucauugcuuugagcuacauuuugugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30920 - RNA, 1701 nt, Artificial Sequence
  hemagglutinin__InfluenzaA__ABB46392
augaagacuaucauugcuuugagcuacauuuucugucuggcuuucgcccaagaccuuccaggaaaugacaacagcacagcaacgcugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacccuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaauucugacaaacuauacauuugggggguucaccacccgaacacggacaaagaacaaaccgaccuauauguucaagcaucagggaaagucacagucuccaccaagagaagccagcaaacuauaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaaacagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaagggcaacauuaggugcaacauuugcauuuga

SEQ ID NO: 30921 - RNA, 1701 nt, Artificial Sequence
  hemagglutinin__InfluenzaA__ABB46414
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaaugugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuuguuuuguguuguuuugcugggguucaucaugugggccugccaaaaaggcaacauuaggugcaacauuugcauuuga

SEQ ID NO: 30922 - RNA, 1701 nt, Artificial Sequence
  hemagglutinin__InfluenzaA__ABB46425
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgagugaccaaauugaagugacuaaugcuacugagcugguucagaguuccucaacagguaaaauaugcgacagcccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuuugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuucugauuaacagcacagggaaucuaauugcuccucgggguuacuucaaaauacgaagugggaaaagcucaauaaugaggucagaugcacccauuggcaaaugcaauucugaaugcaucacuccaaauggaagcauccccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaucaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30923 - RNA, 1701 nt, Artificial Sequence
  hemagglutinin__InfluenzaA__ABB46436
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauaugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauaucccaagcaggauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggagccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30924 - RNA, 1701 nt, Artificial Sequence; identical to SEQ ID NO: 30857
  hemagglutinin__InfluenzaA__ABB46447

SEQ ID NO: 30925 - RNA, 1701 nt, Artificial Sequence
  hemagglutinin__InfluenzaA__ABB46458
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaaaccaacaaacuguaaucccgaacaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaagucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauaugucgaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggggugccaaaaaggcaacauuaggugcaacauuugcauuuga

SEQ ID NO: 30926 - RNA, 1701 nt, Artificial Sequence
  hemagglutinin__InfluenzaA__ABB51961
augaagacuaucauugcuuuaagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuucucaacaggugggauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccugcgugaggucacuaguugccucauccggcacacuggaguuuaacaaugaaagcuucaauugggcuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuacccaaagaugcaaacaacuuguaaucccgaauaucggaucuagacccaggguaagggaugucuccagcagaauaagcaucuauuggacaauaguaaacccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaagaccucgagaaauauguugaggacacuaaaauagaucucuggucauacaacgcggagcuucuuguugcccuggaaaaccaacauacaauugaucuaacugacucagaaaugaacaaacuguuugaaagaacaaagaagcaacugagggaaaaugcugaggauaugggcaaugguuguuucaaaauauaccacaaaugcgacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30927 - RNA, 1698 nt, Artificial Sequence
  hemagglutinin__InfluenzaA__ABB51962
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugaaagauucgaaauauuccccaaaggaagcucauggcccaaccacaccgugaccggaguaucagcaucaugcucccauaaugggaaaagcaguuucuacagaaauuugcuauggcugacggggaaaaaugguuuguauccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaagaaggaagaaucaacuacuacuggacucugcuggaacccggggacacaauaauauuugaggcaaauggaaaucuaauagcgccaugguaugcuuucgcaaugaguagaggcuuuggaucaggaaucagcaccucaaaugcaccaaugggugaaugugaugcgaaauuucaaacaccucagggagguauaaacauuagucuuccuuuccagaauguacacccaguuacaauaggagaguguccaaauuaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguucugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30928 - RNA, 1701 nt, Artificial Sequence
  hemagglutinin__InfluenzaA__ABB51963
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccgaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaaggcauauccccagcagaauaagcaucuauuggacaauaguaaauccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaaauagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugagaagcugaauagguugaucgggaaaaccaacgagaaauuccaucagauugaaaaagaauucucagaaguagaagggagaauucaggaccucgagaaauaugucgaggacacuaaaauagaucucuggucauacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaguauaccacaaaugugacaaugccugcauagggucaaucagaaauggaacuuaugaccauaauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30929 - RNA, 1701 nt, Artificial Sequence
  Hemagglutinin__InfluenzaA__ABB51964
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30930 - RNA, 1698 nt, Artificial Sequence
  hemagglutinin__InfluenzaA__ABB53603
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaaaagaaagaaguccucauacuaugggguguucaucacccgccuaacauagggaaccaaaggacccucuauuacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 30931 - RNA, 1701 nt, Artificial Sequence
  hemagglutinin__InfluenzaA__ABB53614
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagagauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30932 - RNA, 1701 nt, Artificial Sequence; identical to SEQ ID NO: 30764
  hemagglutinin__InfluenzaA__ABB53625

SEQ ID NO: 30933 - RNA, 1701 nt, Artificial Sequence; identical to SEQ ID NO: 30826
  hemagglutinin__InfluenzaA__ABB53652

SEQ ID NO: 30934 - RNA, 1701 nt, Artificial Sequence
  hemagglutinin__InfluenzaA__ABB53663
augaagacuaucuuugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaauuuugacaaauuguacauuuggggaguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30935 - RNA, 1701 nt, Artificial Sequence
  hemagglutinin__InfluenzaA__ABB53685
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30936 - RNA, 1701 nt, Artificial Sequence
  hemagglutinin__InfluenzaA__ABB53696
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguauugcuuugcugggguucaucaugugggccugccaaaaaggcaacauuaggugcaacguuugcauuuga

SEQ ID NO: 30937 - RNA, 1698 nt, Artificial Sequence
  hemagglutinin__InfluenzaA__ABB53707
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaagggagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30938 - RNA, 1701 nt, Artificial Sequence; identical to SEQ ID NO: 30892
  hemagglutinin__InfluenzaA__ABB53718

SEQ ID NO: 30939 - RNA, 1698 nt, Artificial Sequence
  hemagglutinin__InfluenzaA__ABB53740
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagcuccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccaaucacaccguaaccggaguaucagcaucaugcucccauaaugggaaaagcaguuuuuacagaaauuugcuauggcugacggggaagaauggccuguacccaaaccugagcaaguccuaugcaaacaacaaagagaaagaaguccuuguacuaugggguguucaucacccgccuaacaugggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggagacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaacaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30940 - RNA, 1701 nt, Artificial Sequence
  hemagglutinin__InfluenzaA__ABB53751
augaagacuaucauugcuuugagcuacauuuccugucugguuuucgcccaaaaccuucccggaaaugacaacagcacagcaacgcugugccugggacaucaugcagugccaaacggaacgcuagugaaaacaaucacgaaugaccagauugaagugacuaaugcuacugagcugguucagaguuccucaacagguagaauaugcgacaguccucacagaauccuugaugggaaaaacugcacacugauagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggagucacucagagugggggaagcuaugcuugcaaaaggggaucugauaacaguuucuucaguagacugaacugguuguacaaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaagccagcaaacuauaaucccgaauaucgggucuagacccuggguaaggggucugucuaguggaauaaguaucuauuggacaauaguaaaaccgggagacauacuguuaauuaauaguaaugggaaccuaauugcuccucgggguuacuucaaaauacgcacugggaaaagcucaauauugaggucagaugcaccuauuggcaccugcaguucugaaugcaucacuccaaauggaagcauucccaaugacaagcccuuucaaaacguaaacaagaucacauauggggcauguccaaaguauguuaagcaaaacacucuaaaguuggcaacagggaugcggaauguaccagagaaacaaacuagaggcauauucggcgcaauagcagguuucauagaaaaugguugggagggaaugguagauggcugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaaggaagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 30941 - RNA, 1701 nt, Artificial Sequence
  hemagglutinin__InfluenzaA__ABB60007
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagauagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcuuaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30942 - RNA, 1701 nt, Artificial Sequence
  hemagglutinin__InfluenzaA__ABB77853
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccagauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30943 - RNA, 1701 nt, Artificial Sequence
  hemagglutinin__InfluenzaA__ABB79731
augaagacuaucauugcuuugagcuacauucuaugucugguuuucgcucaagaacuucccggaaaugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaccagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuuuaggcaucaaaauucugagggaauaggacaagcagcagaucucaaaagcacucaagcagcaaucaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguucgaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30944 - RNA, 1701 nt, Artificial Sequence
  hemagglutinin__InfluenzaA__ABB79788
augaagacuaucauugcuuugagcuacauuuucugucugguuuucgcccaaaaacuucccggaaaugacaacagcacagcaacgcugugcuugggacaucaugcagugccaaacggaacgcuagugaaaacaaucacgaaugaucaaauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaaagcaaauauccagugcugaacgugacuaugccaaacaauggcaaauuugacaaauuguacauuugggggguucaccacccgaucacggacaaagaacaaaccaaccuauauguucgagcaucagggagagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugauucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30945 - RNA, 1701 nt, Artificial Sequence
  hemagglutinin__InfluenzaA__ABB79799
augaagacuaucauugcuuugagcuacauuuucugucugguuuucgcccaaaaacuucccggaaaugacaacagcacagcaacgcugugcuugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcaguaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaaagcaaauauccagugcugaacgugacuaugccaaacaauggcaaauuugacaaauuguacauuugggggguucaccacccgagcacggacaaagaacaaaccaaccuauauguucgagcaucagggaaagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacuggaaaccuaauugcuccucgggguuacuucaaaauacgcacugggaaaagcucaauaaugaggucagaugcaccuauuggcaccugcaguucugaaugcaucacuccgaauggaagcauucccaaugacaaacccuuucaaaauguaaacaagaucacauauggagcaugucccagguauguuaagcaaaacacucugaaguuggcaacagggaugcggaauguaccagagaagcaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaacagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugauucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 30946 - RNA, 1701 nt, Artificial Sequence
  hemagglutinin__InfluenzaA__ABB79810
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagacuaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcagaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucaguccaguagaauaagcaucuauuggacaauaguaaaaccgggagacauacuuuugauugauagcacagggaaucuaauugcuccucgggguuacuucaaaauacgaaaugggaaaagcucaauaaugagaucagaugcacccauuggcaacugcaguucugaaugcaucacuccaaauggaagcauucccaaugacaaaccuuuucaaaauguaaacaggaucacauauggggccugccccagauauguuaagcaacacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacggacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcuaaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 30947 - RNA, 1701 nt, Artificial Sequence
  hemagglutinin__InfluenzaA__ABB79957
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagacuaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcagaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucaguccaguagaauaggcaucuauuggacaauaguaaaaccgggagacauacuuuugauuaauagcacagggaaucuaauugcuccucgggguuacuucaaaauacgaaaugggaaaagcucaauaaugagaucagaugcacccauuggcaacugcaguucugaaugcaucacuccaaauggaagcauucccaaugacaaaccuuuucaaaauguaaacaggaucacauauggggccugccccagauauguuaagcaacacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacggacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcuaaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 30948 - RNA, 1701 nt, Artificial Sequence
  hemagglutinin__InfluenzaA__ABB79968
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagacuaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcagaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucaguccaguagaauaagcaucuauuggacaauaguaaaaccgggagacauacuuuugauuaauagcacagggaaucuaauugcuccucgggguuacuucaaaauacgaaaugggaaaagcucaauaaugagaucagaugcacccauuggcaacugcaguucugaaugcaucacuccaaauggaagcauucccaaugacaaaccuuuucaaaauguaaacaggaucacauauggggccugccccagauauguuaagcaacacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacggacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcuaaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 30949 - RNA, 1698 nt, Artificial Sequence
  hemagglutinin__InfluenzaA__ABB79979
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaacggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaagggagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuaccacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30950 - RNA, 1698 nt, Artificial Sequence
  hemagglutinin__InfluenzaA__ABB79990
augaaagcaaaacuacugguccuguuauguacauuuacagcuacauacgcagacacaauauguauaggcuaccaugccaacaacucaacagacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaaaggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30951 - RNA, 1701 nt, Artificial Sequence
  hemagglutinin__InfluenzaA__ABB80001
augaagacuaucauugcuuugagcuacacucuaugucugguuuuugcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaacuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaagcacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugacguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30952 - RNA, 1701 nt, Artificial Sequence
  hemagglutinin__InfluenzaA__ABB80012
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuauacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 30953 - RNA, 1701 nt, Artificial Sequence
  hemagglutinin__InfluenzaA__ABB80023
augaagaccaucauugcuuugagcuacauuuucuaucuggcucucggccaagaccuuccaggaaaugacaacagcaaagcaacgcugugccugggacaucaugcggugccaaacggaacacuagugaaaacaaucacaaaugaucagacugaagugacuaaugcuacugagcuaguucagagcuccucaacggggaaaauaugcaacaauccucaucgaauccuugauggaauggacugcacacugauagaugcucuacugggggacccucauugugauguuuuucaaaaugagacaugggaccuuuucguugaacgcagcaaagcuuucagcaacuguuacccuuaugauguaccagauuaugccucccuuagaucacuaguugccucgucaggcacucuggaguuuaucacugaggguuucacuuggacugaggucacucagaaugggggaagcaaugcuugcaaaaggggaccugauagcgguuuuuucaguagacugaacugguugaccaaaucaggaagaacauauccagugcugaacgugacuaugccaaacaaugacaauuuugacaaacuauacauuugggggguucaccacccgagcacggaccaagaacaaaccaaccuguauguucaaacaucagggagagucacagucucuaccaggagaagccagcaaacuauaaucccgaauaucggauccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugauaaacccuuucaaaacguaaacaagaucacauauggagcaugccccaaauauguuaagcaagacacccugaaauuggcaacaggaaugcggaauguaccagagaaacaaacuagaggccuauucggcgcaauagcaggcuucauagaaaaugguugggagggaaugauagacgguugguacgguuucaggcaucaaaauucugagggaacaggacaagcagcagaucuuaaaagcacucaagcagccauugaccaaaucaaugggaaauugaacaggauaaucgagaagacgaaugagaaauuccaucaaaucgaaaaggaauucucagaaguagaagggagaauucaggaccucgagaaauacguugaagacacuaaaauagaucuauggucuuacaaugcagagcuucuuguugcucuggagaaucaacacacaauugaucugacugacucggaaaugaacaaacuguuugaaaaaacaagaaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaacagguuucaaaucaaagguguugaacugaaaucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 30954 - RNA, 1701 nt, Artificial Sequence
  hemagglutinin__InfluenzaA__ABB80034
augaagaccaucauugcuuugagcuacauuuucugucugguucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggacuagacugcacacugauagaugcucuauugggggacccucauugugauguuuuucaaaaugagacaugggaccuuuucguugaacgcagcaaagcuuucagcaacuguuacccuuaugaugugccagauuaugcaucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaucacccgagcacgaaccaagaacaaaccagccuguauguucaagcaucagggagagucacaguuucuaccaggagaagccagcagacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaacuauugauaccuguauuucugaaugcaucacuccaaauggaagcauucccaaugacaaacccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaagaaggcaacugagggaaaaugcugaagacaugggcaaugguugcuucaaaauauaccacaaaugugacaacgcuugcauugagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 30955 - RNA, 1698 nt, Artificial Sequence; identical to SEQ ID NO: 30868
  hemagglutinin__InfluenzaA__ABB80045

SEQ ID NO: 30956 - RNA, 1701 nt, Artificial Sequence
  hemagglutinin__InfluenzaA__ABB80081
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucacagaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30957 - RNA, 1701 nt, Artificial Sequence
  hemagglutinin__InfluenzaA__ABB80092
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacauuaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30958 - RNA, 1701 nt, Artificial Sequence; identical to SEQ ID NO: 30935
  hemagglutinin__InfluenzaA__ABB80137

SEQ ID NO: 30959 - RNA, 1701 nt, Artificial Sequence
  hemagglutinin__InfluenzaA__ABB80159
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacaaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaaacaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30960 - RNA, 1701 nt, Artificial Sequence
  hemagglutinin__InfluenzaA__ABB80185
augaagacuaucauugcuuugagcuacauuuuaugucugguuuucgcucaaaaacuucccggaaaugacaacagcacggcaacgcugugucugggacaccaugcagugccaaacggaacgcuagugaaaacaaucacgaaugaccaaauugaagugacuaaugcuacugagcugguucagaguuccucaacagguagaauaugcgacaguccucaccaaauccuugaugggaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguucgaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 30961 - RNA, 1701 nt, Artificial Sequence
  hemagglutinin__InfluenzaA__ABB80207
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugaugacuuccaaaauaaggaaugggaccuuuuuguugaacgcagcaaagccuacagcaacugcuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccaugucauguuuuuugcuuuguguuguuuugcugggguucaucaugugggccugccaaaaaggcaacauuaggugcaacauuugcauuuga

SEQ ID NO: 30962 - RNA, 1701 nt, Artificial Sequence
  hemagglutinin__InfluenzaA__ABB80229
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccaugucauguuuuuugcuuuguguuguuuugcugggguucaucaugugggccugccaaaaaggcaacauuaggugcaacauuugcauuuga

SEQ ID NO: 30963 - RNA, 1701 nt, Artificial Sequence
  hemagglutinin__InfluenzaA__ABB80240
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcaucuga

SEQ ID NO: 30964 - RNA, 1701 nt, Artificial Sequence
  hemagglutinin__InfluenzaA__ABB80251
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcuuaagucaggauacaaagauuggauccuauggauuuccuuugccauaucauguuuuuugcuuuguguuguuuugcuggggcucaucaugugggccugccaaaaaggcaacauuaggugcaacauuugcauuuga

SEQ ID NO: 30965 - RNA, 1701 nt, Artificial Sequence
  hemagglutinin__InfluenzaA__ABB80492
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaauuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagauaaaagguguugagcugaagucaggauacaaagauuggauccuauggauuuccuuugccaugucauguuuuuugcuuuguguuguuuugcugggguucaucaugugggccugccaaaaaggcaacauuaggugcaacauuugcauuuga

SEQ ID NO: 30966 - RNA, 1701 nt, Artificial Sequence
  hemagglutinin__InfluenzaA__ABB80503
augaagacuaucauugcuuugagcuacauuucaugucugguuuucgcucaaaaacuucccggaaaugacaacaacacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaggucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30967 - RNA, 1701 nt, Artificial Sequence
  hemagglutinin__InfluenzaA__ABB80514
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30968 - RNA, 1701 nt, Artificial Sequence
  hemagglutinin__InfluenzaA__ABB80529
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagauaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30969 - RNA, 1701 nt, Artificial Sequence
  hemagglutinin__InfluenzaA__ABB80641
augaagacuaucauugcuuugagcuacauuuuaugucuuguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugucggauuaugccucccuuaggucacuaguugccucauccggcacccuggaguuuaacaaugaaagcuucaauuggacuggagucgcucagaauggaacaagcuacgcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30970 - RNA, 1701 nt, Artificial Sequence
  hemagglutinin__InfluenzaA__ABB80661
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaagccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30971 - RNA, 1701 nt, Artificial Sequence
  hemagglutinin__InfluenzaA__ABB80672
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucaggguuccucaacagguagaauaugcgacaguccucaccaaauccuugauggaaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaacucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguucgaaagaacaagaaagcaacugagggaaaaugcugaggacaugggcaaugguugcuucaaaauauaccacaaaugugacaaugccugcauagggucaaucagaaauggaacuuaugaucaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 30972 - RNA, 1701 nt, Artificial Sequence
  hemagglutinin__InfluenzaA__ABB80682
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuggaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30973 - RNA, 1701 nt, Artificial Sequence
  hemagglutinin__InfluenzaA__ABB80693
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaaugugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30974 - RNA, 1701 nt, Artificial Sequence
  hemagglutinin__InfluenzaA__ABB80704
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugaccaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30975 - RNA, 1701 nt, Artificial Sequence
  hemagglutinin__InfluenzaA__ABB80715
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30976 - RNA, 1701 nt, Artificial Sequence
  hemagglutinin__InfluenzaA__ABB80724
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaagccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccaugucauguuuuuugcuuuguguuguuuugcugggguucaucaugugggccugccaaaaaggcaacauuaggugcaacauuugcauuuga

SEQ ID NO: 30977 - RNA, 1701 nt, Artificial Sequence
  hemagglutinin__InfluenzaA__ABB80737
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguucuucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaaugugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccaugucauguuuuuugcuuuguguuguuuugcugggguucaucaugugggccugccaaaaaggcaacauuaggugcaacauuugcauuuga

SEQ ID NO: 30978 - RNA, 1701 nt, Artificial Sequence
  hemagglutinin__InfluenzaA__ABB80748
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggaggucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuacccaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgaggaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30979 - RNA, 1701 nt, Artificial Sequence
  hemagglutinin__InfluenzaA__ABB82183
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuucguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggaggucuaauaaaaguuucuuuaguagauugaauugguugcaccaauugaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacagacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaguaaugaggucagaugcauccauuggcagaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgaaaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaauggcuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 30980 - RNA, 1698 nt, Artificial Sequence; identical to SEQ ID NO: 30937
  hemagglutinin__InfluenzaA__ABB82194

SEQ ID NO: 30981 - RNA, 1698 nt, Artificial Sequence
  hemagglutinin__InfluenzaA__ABB82205
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacaaaaauuugcuauggcugacggggaagaaugguuuguacccaaaccugagcaaguccuaugcaaacagcaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauagggaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30982 - RNA, 1698 nt, Artificial Sequence
  hemagglutinin__InfluenzaA__ABB82216
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucaucaucaugcucccauaaugggaaaagcaguuuuuacagaaauuugcuauggcugacggggaagaaugguuuguacccaaaccugagcaaguccuauguaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaagguaugcuuucgcacugaguaggggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggggccauugccgguuucauugaagggggguggacuggaaugguagaugguugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaauaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 30983 - RNA, 1701 nt, Artificial Sequence
  hemagglutinin__InfluenzaA__ABB82227
augaagaccaucauugcuuugagcuacauuuucugucugacucucggccaagaccuuccaggaaaugacaacagcaaggcaacgcugugccugggacaucaugcggugccaaacggaacacuagugaaaacaaucacagaugaucagacugaagugacuaaugcuacugagcuaguucaaagcuccucaacggggaaaauaugcaacaauccucaucgaauccuugauggaauggacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuagcugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaaacaccuauccagugcugaacgugacuaugccaaacaaugacaauuuugacaaacuauacauuugggggguucaccacccgagcacggaccaagaacaaaccagccuguauguucaagcaucagggagagucacagucucuaccaggagaagccagcaaacuauaaucccgaauaucggauccagacccuggguaaggggucugucuaguagaauaagcaucuauuggacaauaguuaagccgggagacguacuuguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaaacccuuucaaaacauaaacaagaucacauauggagcaugccccaaguauguuaagcaaaacacccuaaaguuggcaacagggaugcggaauguaccagagaaacaaaccagaggccuauucggcgcaauagcagguuucauagaaaaugguugggagggaaugauagacgguugguacgguuucaggcaucaaaauucugagggcacaggacaagcggcagaucuuaaaagcacucaagcagccaucgaccaaaucaaugggaaauugaacaggauaaucgagaagacgaacgagaaauuccaucaaaucgaaaaggaauucucagaaguagaagggagaauucaggaccucgagaaauacguugaagacacuaaaauagaucuauggucuuacaaugcggagcuucuugucgcuauggagaaucaacauacaauugaucugacugacucggaaaugaacaaacuguuugaaaaaacaagaaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaacagguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 30984 - RNA, 1698 nt, Artificial Sequence
  hemagglutinin__InfluenzaA__ABB83026
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccccuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggagaagaaugguuuguacccaaaccugagcaaguccuaugcaaacaacaaagagaaagaaguccuuauacuaugggguguucaucacccgccuaacauaggggaccaaaggacccucuaucauacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagacgggugguaugguuaucaucaucagaaugagcaaggaucuggcuaugcugcagaucaaaaaagcacacaaaacgccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccacgacuccaaugugaagaaucuguaugagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaaucgauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 30985 - RNA, 1698 nt, Artificial Sequence
  hemagglutinin__InfluenzaA__ABB83127
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaucucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 30986 - RNA, 1698 nt, Artificial Sequence
  hemagglutinin__InfluenzaA__ABB83138
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaauaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcuaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 30987 - RNA, 1701 nt, Artificial Sequence
  hemagglutinin__InfluenzaA__ABB86877
augaaggcaauacuauuaauauugcuguauacauuuacagccacaaaugcagacacacuauguauagguuaucaugcaaauaauucaacugacacuguugauacagugcuggaaaagaauguaacaguaacacauucuguuaaccuucuagaagacagacauaacggaaaacuaugcaaccuagggggaauagccccauuguacuuggguaauuguaacauugcuggauggcuuuugggaaacccagaaugugaauuacuauucacaguaagcucaugguccuacauuguggaaacaucuaacucagacaaugggacauguuacccuggagauuucaucaauuaugaagagcugagagagcaguugagcucaaugucaucauaugaaagauuugagauauuccccaaagaaaguucauggcccaaucaugaaacaaacaggggugugacugcagcaugccccuaugcuggagcaaacaguuucuacagaaacuuaauauggcugguaaaaaaaggaaauucauacccaaagaucaacaaauccuauguuaauaauaaagagaaggaaguccuugugcuauggggcauucaccauccaccuaccagugcugaccaacaaagucucuaucagaaugcagaugccuauguuucuguggagucaucaaaguacaacaagaaauuuaagccagaaauagcaacaagacccaaggugagaggucaagcagggagaaugaacuauuacuggacauuaguagagccuggagacacaauaacauucgaagcaacuggaaaccuagugguaccaagguaugccuuugcaaugaauagagguucuggaucugguaucauaauuucagauaccccaguucacgauuguaauacgacuugucaaacacccaaaggugcuauaaacaccagccucccauuucagaauguacauccagucacaauuggagaauguccaaaauaugucaaaagcacaaaauugagaauggcuacaggauuaaggaauaucccgucuauucaaucuagaggucuguuugaagccauugcuggcuuuauugaggggggauggacaggaaugauagauggaugguacgguuaucaccaucaaaaugagcagggaucaggauaugcagcugaccgaaagagcacacagaaugccauugacgggaucacuaacaaaguaaacucuguuauugaaaagaugaacacacaauucacagcaguggguaaagaauucaaccaccuggaaaaaagaauagagaauuuaaacaaaaagguugaugaugguuuucuggauguuuggacuuauaaugccgaacugcuaguucuauuggaaaaugaaagaacuuuagauuuccaugacucaaaugugaaaaaucuauaugagaaaguaagaagccagcuaaggaacaaugccaaggaaauugggaauggaugcuuugaauucuaccauaaaugugaugacacaugcauggagagcgucagaaaugggacuuaugauuaccuaaaguacucagaagaaucaaaacuaaauagagagaaaauagagggggugaaguuggauucagcaagaauuuaccagauuuuggcgauauauucaacugucgccaguucauugguacuauuggucucccugggggcaaucaguuucuggaugugcucuaaugggucuuuacagugcagaauauguauuuaa

SEQ ID NO: 30988 - RNA, 1701 nt, Artificial Sequence
  hemagglutinin__InfluenzaA__ABB86887
augaaggcaauacuauuaauauugcuguauacauuuacagccacaaaugcagacacacuauguauagguuaucaugcaaauaauucaacugacacuguugauacagugcuggaaaagaauguaacaguaacacauucuguuaaccuucuagaagacagacauaacggaaaacuaugcaaccuagggggaauagccccauuguacuuggguaauuguaacauugcuggauggcuuuugggaaacccagaaugugaauuacuauucacaguaagcucaugguccuacauuguggaaacaucuaacucagacaaugggacauguuacccuggagauuucaucaauuaugaagagcugagagagcaguugagcucaaugucaucauaugaaagauuugagauauuccccaaagaaaguucauggcccaaucaugaaacaaacaggggugugacugcagcaugccccuaugcuggagcaaacaguuucuacagaaacuuaauauggcugguaaaaaaaggaaauucauacccaaagaucaacaaauccuauguuaauaauaaagagaaggaaguccuugugcuauggggcauucaccauccaccuaccagugcugaccaacaaagucucuaucagaaugcagaugccuauguuucuguggagucaucaaaguacaacaagaaauuuaagccagaaauagcaacaagacccaaggugagaggucaagcagggagaaugaacuauuacuggacauuaguagagccuggagacacaauaacauucgaagcaacuggaaaucuagugguaccaagauaugccuucgcaaugaaaagagguucuggaucugguauuaucauuucagauacaccaguccacgauuguaauacgacuugucaaacacccaaaggugcuauaaacaccagccucccauuucagaauauacauccagucacaauuggagaauguccaaaauaugucaaaagcacaaaauugagaauggcuacaggacuaaggaauaucccgucuauucaaucuagaggucuguuuggagccauugcuggcuuuauugaggggggauggacaggaaugauagauggaugguacgguuaucaccaucaaaaugagcagggaucaggauaugcagcugaccgaaagagcacacagaaugccauugacggaaucacuaacaaaguaaacucuguuauugaaaagaugaacacacaauucacagcaguggguaaagaauucaaccaccuggaaaaaagaauagagaauuuaaacaaaaagguugaugaugguuuucuggauguuuggacuuauaaugccgaacugcuaguucuauuggaaaaugaaagaacuuuagauuuccaugacucaaaugugaaaaaucuauaugagaaaguaagaagccagcuaaggaacaaugccaaggaaauugggaauggaugcuuugaauucuaccauaaaugugaugacacaugcauggagagcgucagaaaugggacuuaugauuaccuaaaguacucagaagaaucaaaacuaaauagagagaaaauagagggggugaaguuggauucagcaagaauuuaccagauuuuggcgauauauucaacugucgccaguucauugguacuauuggucucccugggggcaaucaguuucuggaugugcucuaaugggucuuuacagugcagaauauguauuuaa

SEQ ID NO: 30989 - RNA, 1698 nt, Artificial Sequence
  hemagglutinin__InfluenzaA__ABB86899
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaagggauagccccccuacaauuggguaauugcagcguugccggguggaucuuaggaaacccagaaugcgaauuacugauuucuaaggaaucaugguccuacauuguagaaacaccaaauccugagaauggagcauguuacccagggcauuucgccgacuaugaggagcuaagggagcaauugaguucaguaucuucauuugagagauucgaaauauuccccaaagaaagcucauggcccaaccacaccauaaccggaguaucagcaucaugcucccauaaugggaaacgcaguuuuuacagaaaucugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaagacccaaaguaagagaucaggaaggaagaaucaacuacuacuggacucugcuggaacccggggauacaauaauauuugaggcaaauggaaauuuaauagcgccaugguaugcuuucgcacugaguagagguuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggaucacaaacaaggugaauucuguaauugagaaaaugaacacucaguucacagcugugggcaaagaauucagcaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaggccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugauucuuuuggucucccugggggcuaucagcuucuggauguguuccaaugggucuuugcaguguagaauaugcaucuga

SEQ ID NO: 30990 - RNA, 1701 nt, Artificial Sequence
  hemagglutinin__InfluenzaA__ABB86907
augaaggcaauacuauuagucuuguuauacacauuuacauccacaaaugcagacacauuauguauagguuaucaugcaaauaauucaacugacacuguugauacgguauuagaaaagaauguaacaguaacacacucuguuaaucuucuggaagacaaacacaacggaaaguuaugcagacuagggggaauagccccguuacacuuggguaaauguaacauugcuggauggcuuuuaggaaacccagaaugugacuuacuacucacaguaagcucauggucuuacauuguggaaacaucuaacucauacaaugggacauguuacccaggagauuucaccaauuaugaggagcugagagagcaauugagcucagugucaucauucgaaagauuugagauauuccccaaggcaagcucauggcccaaucaugaaacaaacagaggugugacagcagcaugcccucaugcugggacaaacagcuuuuacagaaauuuaauauggcuggugaaaaaaggaaauacauauccaaagcucagcaaauccuauguuaacaauaaagggaaggagguucuuguauuauggggcauucaccacccaucuaccaguacugaucaacaaagucucuaccagaaugcagauaccuauguuuuuguggggacaucaaaguauaacaagaaauucaagccggaaauagcagugagacccaaagugaaagaccaagcagggagaaugaauuauuacuggacauuaguagaaccuggggacacaauaacauuugaagcaacuggaaaccuaguaguaccaagauaugccuuugcaaugaauagaggccauggauccgguauuauuauuucagacaccccaguccaugauuguaauacgacuugucaaacacccaaaggugcuauaaacaccagccucccauuucagaaugugcauccagucacaauuggaaaauguccaaaauaugucaaaagcacaagauugagaauggcuacaggauuaaggaauauuccaucuauucaaucuagaggccuguuuggagcuauugcugguuuuauugaaggaggauggacaggaaugauagauggaugguaugguuaucaccaccaaaaugggcagggaucaggauaugcagcugaccaaaagagcacacagaaugccauugacggaaucacuaacaaaguaaauucuguuauugaaaagaugaacacacaguucacagcaguggguaaagaauucaaccacuuggaaaaaagaauagaaaaucuaaacaaaaagguugaugaugguuuucuagauguuuggacuuacaaugccgaacuguugguccuauuggagaaugaaagaacuuuggauuuccacgacucgaaugugaagaaccuauaugaaaaaguaagacgccagcuaaagaacaaugcuaaggaaauugggaauggcuguuuugaguuuuaccauaauugugaugaugcauguauggagagugucaaaaauggaacuuaugauuacccaaaauacucagaagagucacgacuaaacagagaggaaauaaauggaauaaaauuggauucaacaagaauuuaucagauuuuggcgaucuauucaacugucgccagcucaucagugcuguuggucucccugggggcaaucaguuucuggaugugcuccaaugggucuuuacaaugcagaauauguauuuag

SEQ ID NO: 30991 - RNA, 1698 nt, Artificial Sequence
  hemagglutinin__InfluenzaA__ABB86917
augaaaguaaaacugcugauccuguuauguacauuuacagcuacauaugcagacccaauauguauaggcuaccaugccaacaacucaaccgacacuguugacacaguacuugagaagaauguggcaguaacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucaaaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaauuaaacagggaaaaaauugauggagugaaauuggacucaaugggggucuaucagauucuggcgaucuacucaacugucgccaguucccugguucuuuuagucucccugggggcaaucagcuucuggauguguuccaaugggucuuugcaguguagaauaugcaucuga

SEQ ID NO: 30992 - RNA, 1698 nt, Artificial Sequence
  hemagglutinin__InfluenzaA__ABB86929
augaaaguaaaacuacugauccuguuauauacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaagggauagccccccuacaauuggguaauugcagcguugccggguggaucuuaggaaacccagaaugcgaauuacugauuuccaaggaaucaugguccuacauuguagaaacaccaaauccugagaauggagcauguuacccagggcauuucgccgacuaugaggagcuaagggagcaauugaguucaguaucuucauuugagagauucgaaauauuccccaaagaaagcucauggcccaaccacaccauaaccggaguaucagcaucaugcucccacaaugggaaacgcaguuuuuacagaaaucugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaagacccaaaguaagagaucaggaaggaagaaucaacuacuacuggacucugcuggaacccggggauacaauaauauuugaggcaaauggaaaucuaauagcgccaugguaugcuuucgcacugaguagagguuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggaucacaaacaaggugaauucuguaauugagaaaaugaacacucaguucacagcugugggcaaagaauucagcaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaccuguacgagaaaguaaaaggccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugauucuuuuggucucccugggggcuaucagcuucuggauguguuccaaugggucuuugcaguguagaauaugcaucuga

SEQ ID NO: 30993 - RNA, 1701 nt, Artificial Sequence
  hemagglutinin__InfluenzaA__ABB86937
augaaagcaauacuauuagucuuguuauauacauuuacauccacaaaugcagacacauuauguauagguuaucaugcaaauaauucaacugacacuguugauacaguacuagaaaagaauguaacgguaacacacucuguuaaucuucuagaagacaaacacaauggaagguuaugcaaacuagggggaauagccccauuacacuuggguaaauguaacauugcuggauggcuuuugggaaacccagaaugugaauuacuauucacaguaagcucauggucuuacauuguggaaacaucuaacucauacaaugggacauguuacccaggggauuucaucaauuaugaggagcugagggagcaauugagcucagugucaucauucgaaagauuugagauauuccccaaggcaaguucauggcccaaucaugaaacaaacagaggugugacagcagcaugcccacaugcugggacaaacagcuuuuacagaaauuuaauauggcuggugaaaaaaggaaauacauauccaaagaucagcaaauccuauguuaacaauaaagggaaggaaguucuuguguuauggggcauucaccauccaucuaccaguaaugaucaacaaagucucuaccagaaugcagauaccuauguuuuugugggaccaucaaaguauaacaagaaauucaagccggaaauagcaacgagacccaaagugagagaucaagcagggagaaugaacuauuacuggacacuaguagaaccuggggauacuauaacauucgaagcaacuggaaaccuaguaguaccaagguaugccuuugcaaugaauagagguucugaaucugguauuauaauuucagacacaccaguucaugauuguaauacuacuugucaaacacccaaaggugcuauaaacaccagccucccauuccagaauguacauccagucacaauuggagaauguccaaaauaugucaaaagcacaagauugagaauggcuacaggauuaaggaauaucccaucuauccaaucuaggggucuguuuggagcuauugcugguuuuauugaggagggguggacaggaaugauagauggaugguaugguuaccaccaucaaaaugggcagggaucaggauaugcagcugaccaaaagagcacacaaaaugccauugacggaaucaccaacaaaguaaauucuguuauugaaaagaugaacacacaguucacagcaguagguaaagaauucaaccacuuagaaaaaagaauagaaaaucuaaacaaaaagguugaugaugguuuucuggauguuuggacuuacaaugccgaacuguugguccuauuggagaaugaaagaaccuuggauuuccacgacucgaaugugaagaaccuauaugaaaaaguaagacgccagcuaaagaacaaugcuaaggaaauugggaauggcuguuuugaguucuaccacaaaugugaugaugcauguauggagagugucaaaaaugggacuuaugauuacccaaaauacucagaagaaucacgacuaaacagagaggaaauaaauggaauaaaacuggauucaacaaggauuuaccagauuuuggcgaucuauucaacugucgccagcucaucgguacuguuggucucccugggggcaaucaguuucuggaugugcuccaaugggucuuuacagugcagaauauguauuuaa

SEQ ID NO: 30994 - RNA, 1701 nt, Artificial Sequence
  hemagglutinin__InfluenzaA__ABB86946
augaaagcaauacuauuagucuugcuauauacauuuacagccgcaaaugcagacacacuauguauagguuaucaugcaaauaauucaacugacacuguugauacaguacuagaaaagaauguaacaguaacacacucuguuaaccuucuagaagacagacauaacggaaaacuaugcaaacuaaggggaauagccccauugcacuuggguaaauguaacauugcuggauggcuuuugggaaacccagaaugugaaucacuauccacaguaagcucauggucuuacauuguggaaacaucuaacucagacaaugggacauguuacccaggagauuucaucaauuaugaggagcugagagagcagcugaguucagugucaucauuugaaagauuugagauauuccccaaggcaaguucauggcccaaucaugaaacaaacagagguacgacggcagcaugcccuuaugcuggagcaaacagcuucuacagaaauuuaauauggcuggugaaaaaaggaaauucauacccaaagcucaacaaauccuauguuaacaauaaggggaaggaaguccuugugcuauggggcauucaccauccaucaaccaguaaugagcaacaaagucucuaccagaaugcagauaccuauguuuuugugggaucaucaaaguauaacaagaaauucaagccagaaauagcaacaagacccaaagugagagaucaagcagggagaaugaacuauuacuggacauuaauagaaccuggggacacaauaacauucgaagcaacuggaaaccuagugguaccaagguaugccuuugcaaugaauagagguucuggaucugguauuauaauuucagauacaccaguucacgauuguaauacuacuugucaaacacccaaaggugcuauaaacaccagccucccauuucagaauguacauccagucacaauuggagaauguccaaaauaugucaaaagcacaaaauugagaauggcuacaggauuaaggaauaucccgucuauucaaucuagaggucuguuuggagcuauugcugguuuuauugaagggggauggacagguaugauagauggaugguaugguuaucaccaccaaaaugagcagggaucaggauaugcagcugaccaaaagagcacacagaaugccauugacgggaucacuaacaaaguaaauucuguuauugaaaagaugaacacacaguucacagcaguggguaaagaauucaaccacuuggaaaaaagaauagaaaauuuaaacaaaaagguugaugaugguuuucuggacguuuggacuuacaaugccgaacuguugguacuauuggaaaaugaaagaacuuuggauuuccacgacucuaauguuaagaaccuauaugaaaaaguaagaagccagcuaaagaacaaugcuaaggaaauugggaauggcuguuuugaguucuaccacaaaugcgaugaugcauguauggagagugucaaaaaugggacuuaugauuacccaaaauacucagaagaaucaagacuaaacagagaggaaauagauggaauaaaacuggauucaacaagaauuuaccagauuuuggcgaucuauucaacugucgccaguucaucaguacuguuggucucccugggggcaaucaguuucuggaugugcuccaaugggucuuuacagugcagaauauguauuuaa

SEQ ID NO: 30995 - RNA, 1701 nt, Artificial Sequence
  hemagglutinin__InfluenzaA__ABB96319
augaagacuaucauugcuuugagcuacauuuucugucagguuuucgcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaauccucaucgaauccuugauggaaaaaacugcacacugauagaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuuucaaugaaggcuucaauuggacuggggucacucagaaugggggaagcuaugcuuguaaaaggggaccugauaacaguuucuucaguagacugaacugguuguacaaaucagaaagcacauauccagugcugaacgugacuaugccaaacaaugacaauuuugacaaacuguacauuuggggaguucaccacccgagcacggacaaagaacaaaccaaccuauauguucaagcaucagggagagucacagucuccaccaagagaagccagcaaacuauaaucccgaaugucgggccuagacccuggguaaggggucugucuaguagaauaagcaucuauuggacaauagugaaaccgggagacguacuguuaauuaauaguaaugggaaccuaauugcuccucgggguuacuucaaaauacgcacugggaaaagcucaauaaugaggucagaugcacccauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaaaacaaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 30996 - RNA, 1701 nt, Artificial Sequence
  hemagglutinin__InfluenzaA__ABB96330
augaagacuaucauugcuuugagcuacauuuucugucagguuuucgcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaauccucaucgaauccuugauggaaaaaacugcacacugauagaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuuucaaugaaggcuucaauuggacuggggucacucagaaugggggaagcuaugcuuguaaaaggggaccugauaacaguuucuucaguagacugaacugguuguacaaaucagaaagcacauauccagugcugaacguaacuaugccaaacaaugacaauuuugacaaacuguacauuuggggaguucaccacccgagcacggacaaagaacaaaccaaccuauauguucaagcaucagggagagucacagucuccaccaagagaagccagcaaacuauaaucccgaaugucgggucuagacccuggguaaggggucugucuaguagaauaagcaucuauuggacaauaguaaaaccgggagacguacuguuaauuaauaguaaugggaaccuaauugcuccucgggguuacuucaaaauacgcacugggaaaagcucaauaaugaggucagaugcacccauuggcaccugcaguucugaauguaucacuccaaauggaagcauucccaaugacaggcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagccaucgaccaaaucaaugggaaacugaauaggguaaucgagaaaacaaacgagaaauuccaucaaaucgaaaaggaauucucagaaguagaagggagaauucagaaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 30997 - RNA, 1701 nt, Artificial Sequence
  hemagglutinin__InfluenzaA__ABB96341
augaagacuaucauugcuuugagcuacauuuucugucagguuuuugcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaauccucaucgaauccuugauggaaaaaacugcacacugauagaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuuucaaugaaggcuucaauuggacuggggucacucagaaugggggaagcuaugcuuguaaaaagggaccugauaacaguuucuucaguagacugaacugguuguacaaaucagaaagcacauauccagugcugaacgugacuaugccaaacaaugacaauuuugacaaacuguacauuuggggaguucaccacccgagcacggacaaagaacaaaccaaccuauauguucaagcaucagggagagucacagucuccaccaagagaagccagcaaacuauaaucccgaaugucgggucuagacccuggguaaggggucugucuaguagaauaagcaucuauuggacaauaguaaaaccgggagacguacuguuaauuaauaguaaugggaaccuaauugcuccucgggguuacuucaaaauacgcacugggaaaagcucaauaaugaggucagaugcacccauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacagggcaagcagcagaucuuaaaagcacucaagcagccaucgaccaaaucaaugggaaacugaauaggguaaucgagaaaacaaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 30998 - RNA, 1701 nt, Artificial Sequence
  hemagglutinin__InfluenzaA__ABB96395
augaagacuaucauugcuuugagcuacauuuucugucagguuuucgcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaucgaauccuugauggaaaaaacugcacacugauggaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggggucacucagaaugggggaagcuaugcuugcaaaaggggaccugauaacaguuucuucaguagacugaacugguuguacaaaucagaaagcacauauccagugcugaacgugacuaugccaaacaaugacaauuuugacaaacuguacauuuggggaguucaccacccgagcacggacaaagaacaaaccaaccuauauguucaagcaucagggagagucacagucuccaccaagagaagccagcaaacuauaaucccgaaugucgggucuagacccuggguaaggggucugucuaguagaauaagcaucuauuggacaauaguaaaaccgggagacauacuguuaauuaauaguaaugggaaccuaauugcuccucgggguuacuucaaaauacgcacugggaaaagcucaauaaugagaucagaugcacccauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagagaacaaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 30999 - RNA, 1698 nt, Artificial Sequence
  hemagglutinin__InfluenzaA__ABB96487
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuucccaaaaaaagcucauggcccaaccacaccguaaccggaguaucagcaucaugcucccaugaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 31000 - RNA, 1701 nt, Artificial Sequence
  hemagglutinin__InfluenzaA__ABB96520
augaagaccaucauugcuuugagcuacauuuucugucuggcucucggccaagaccuuccaggaaauggcaacagcacagcaacgcugugccugggacaucaugcggugccaaacggaacacuagugaaaacaaucacagaugaucagaucgaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugauguaccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaucacccgagcacggaccaagaacaaaccagccuguauguucaagcaucagggagggucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaaaacccugaaguuggcaacagggaugcggaauauaccagagaaaaaaacuagaggcauauucggcgcaauagcagguuucauagaaaaugguugggaaggaaugauagacgguugguacgguuucaggcaucaaaauucugagggcacaggacaagcagcagaucuuaaaagcacucaagcagcaaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcugagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 31001 - RNA, 1701 nt, Artificial Sequence
  hemagglutinin__InfluenzaA__ABB96531
augaagacuaucauugcuuugagcuacauuuuaugucugguuuccgcucaaaaaauucccggaaaugacagcagcacagcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31002 - RNA, 1701 nt, Artificial Sequence
  hemagglutinin__InfluenzaA__ABC02234
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauugaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaauaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaccuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccaugucauguuuuuuguuuuguguuguuuugcugggguucaucaugugggccugccaaaaaggcaacauuaggugcaacauuugcauuuga

SEQ ID NO: 31003 - RNA, 1701 nt, Artificial Sequence
  hemagglutinin__InfluenzaA__ABC02255
augaagacuaucauugcuuugagcuacauuuucugucugguucucgcccaagaccuuccaggaaaugacaacagcacagcaacgcugugccugggacaucaugcggugccaaacggaacgcuagugaaaacaaucacgaaugaucagauugaagugacuaaugcuacugagcugguucagagcuccucaacggguaaaauaugcaacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagacuaugccucccuuaggucacuaguugccucgucaggcacucuggaguuuaucaaugaaggcuucaauuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaucccgaauguugggucuagacccuggguaaggggucugucuaguagaauaagcaucuauuggacaauaguuaaaccgggagacauacugguaauuaauaguaaugggaaccuaauugcuccucggggucacuucaaaaugcgcacugggaagagcucaauaaugaggucagaugcaccuauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagcuaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 31004 - RNA, 1701 nt, Artificial Sequence
  hemagglutinin__InfluenzaA__ABC02266
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagggcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31005 - RNA, 1701 nt, Artificial Sequence
  hemagglutinin__InfluenzaA__ABC02288
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaucaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaaugggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggacacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31006 - RNA, 1701 nt, Artificial Sequence
  hemagglutinin__InfluenzaA__ABC02299
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31007 - RNA, 1701 nt, Artificial Sequence; identical to SEQ ID NO: 30998
  hemagglutinin__InfluenzaA__ABC02310

SEQ ID NO: 31008 - RNA, 1701 nt, Artificial Sequence
  hemagglutinin__InfluenzaA__ABC02321
augaagacuaucauugcuuugagcuacauuuucugucugguucucgcccaagaccuuccaggaaaugacaacagcacagcaacgcugugccugggacaucaugcggugccaaacggaacgcuagugaaaacaaucacgaaugaucagauugaagugacuaaugcuacugagcugguucagagcuccucaacggguaaaauaugcaacaauccucaucgaauccuugauggaauaaacuguacacugauagaugcucuauugggggacccucauugugauggcuuucaaaaugagaaaugggaccuuuucguugaacgcagcaaagcuuucagcaacuguuacccuuaugaugugccagacuaugccucccuuaggucacuaguugccucgucaggcacucuggaguuuaucaaugaaggcuucaauuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaucccgaauguugggucuagacccuggguaaggggucugucuaguagaauaagcaucuauuggacaauaguuaaaccgggagacauacugguaauuaauaguaaugggaaccuaauugcuccucggggucacuucaaaaugcgcacugggaagagcucaauaaugaggucagaugcaccuauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagcuaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 31009 - RNA, 1701 nt, Artificial Sequence
  hemagglutinin__InfluenzaA__ABC02332
augaagacuaucauugcuuugagcuacauuuucugucugguucucggccaagauuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccaggagacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31010 - RNA, 1701 nt, Artificial Sequence
  hemagglutinin__InfluenzaA__ABC39805
augaagaccaucauugcuuugagcuacauucucugucugguuuucgcccaaaaccuucccggaaaugacaacagcacagcaacgcugugccugggacaucaugcagugccaaacggaacacuagugaaaacaauaacgaaugaucaaauugaagugaccaaugcuacugagcugguucagaguuccucagcagguagaauaugcgacaguccccaccgaauccuugaugggaaaaacugcacacugauagaugcucuauugggagauccucauugugauggcuuucaaaaugagaaaugggaccuuuuuguugaacgcagcaaagcuuucagcaacuguuacccuuaugaugugcaagauuaugccucccuuaggucacuaguugccucgucaggcacccuggaguuuaucaaugaaggcuucaauuggacuggggucacucagagugggggaagcuaugcuugcaaaaggggaucugguaacaguuucuucaguagacugaacugguuguacaaaucagaaagcaaauauccagcgcugaacgugacuaugccaaacaauggcaauuuugacaaacuguacauuugggggguucaucacccgagcacggacaaagaacaaaccaaccuauauguucgagcgucagggagagucacagucucuaccaagagaagccagcaaacuguaaucccgaauaucgggccuagacccuggguaaggggccugucuaguagaauaaguaucuauuggacaauagugaaaccgggagacauacuguuaauuaauaguagugggaaccuaauugcuccucgggguuauuucaaaauacgcacugggaaaagcucaauaaugaggucagaugcaccuauuggcaccugcaguucugaaugcaucacuccaaauggaagcauucccaaugacaagcccuuccaaaacguaaacaagaucacauauggggcaugucccaaguauguuaagcaaaauacucuaaaauuggcaacagggaugcggaauauaccagagaaacaaacuagaggcauauucggcgcaauagcagguuucauagaaaaugguugggagggaaugguagacggcugguacgguuucaggcaucaaaauucugagggcacaggacaagcagcagaucuuaaaagcacucaagcagcaaucgaccaaaucaaugggaaacugaauaggguaaucgagaaaacuaacgagaaauuccaucaaaucgaaaaggaauucucagaaguagaagggagaauucaggaccucgagaaauacguugaagacacuaaaauagaucucuggucuuacaacgcagagcuucuuguugcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 31011 - RNA, 1698 nt, Artificial Sequence
  hemagglutinin__InfluenzaA__ABC40522
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcuaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 31012 - RNA, 1698 nt, Artificial Sequence; identical to SEQ ID NO: 30861
  hemagglutinin__InfluenzaA__ABC40533

SEQ ID NO: 31013 - RNA, 1701 nt, Artificial Sequence
  hemagglutinin__InfluenzaA__ABC40555
augaagacuaucauugcuuugagcuacauuuucugucugguuuucgcccaaaaccuccccagaaaugacaaaagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugguagaugcucuauugggagacccucauugugauggcuuucagaaugagaaaugggaccuuuuuguugaacgcagcaaagcuuucagcaacuguuacccuuaugaugugccagauuaugccucccuuaggucacuaguugccucgucaggcacccuggaguuuaucaaugaaagcuucaauuggacuggagucacucagagugggggaagcuaugcuugcaaaaggggaucugauaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaagccagcaaacuauaaucccgaauaucgggucuagacccuggguaaggggucugucuagcagaauaagcaucuauuggacaauaguaaaaccgggagacauacuguuaauuaauaguaaugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 31014 - RNA, 1701 nt, Artificial Sequence
  hemagglutinin__InfluenzaA__ABC40608
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagauccauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccagaagaagccaacaaacuguaaucccgaacaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcauuacuccaaauggaagcauucccaaugacaaaccauuucaaaguguaaacaggaucacauauggggccugucccagauauguuaagcaaaacacucugaaauuggcaacagggaugcggaauguaccagagaaacaaacuagaggcauauucggcgcaaucgcugguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaagaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccaaaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31015 - RNA, 1701 nt, Artificial Sequence
  hemagglutinin__InfluenzaA__ABC40619
augaagacuaucauugcuuugagcuacauuuucugucugguucucggccaagacuuuucaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcaaugcuugcaaaaggggaccugauagcgguuuuuucaguagacugaacugguuguacaaaucaggaagcacauauccagugcugaacgugaguaugccaaacaaugacaauuuugacaaacuauacauuugggggguucaccacccgagcacggaccaagaacaaaccaaccuauauguucaagcaucagggagagucacagucuccaccaagagaagucagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuauuucaaaaugcgcacuggaaaaagcucaauaaugaggucagaugcaccuauuggcaccugcauuucugaaugcaucacuccaaauggaagcauucccaaugacaaacccuuucaaaacguaaacaagaucacauauggugcaugucccaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggauaaucgagaagacgaacgagaaauuccaucaaauagaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31016 - RNA, 1698 nt, Artificial Sequence
  hemagglutinin__InfluenzaA__ABC40631
augaaaguaaaacuacugaucuuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccccuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucauacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaacgccauuaacgggauuacaaacaaggugaauucuguaauugagaaaaugaacacucaauucacagcugugggcaaagaauucaacaaauuggaaagaaggauggaaaacuuaaauaaaaaaguugaugauggauuucuagacauuuggacauauaaugcagaauuguugguucuacuggaaaaugaaaggacuuuggauuuccacgacuccaaugugaagaaucuguaugagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31017 - RNA, 1701 nt, Artificial Sequence
  hemagglutinin__InfluenzaA__ABC41692
augaagacuaucauugcuuugagcuacauucuaugucugguuuucgcucaaaaaccucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31018 - RNA, 1698 nt, Artificial Sequence
  hemagglutinin__InfluenzaA__ABC41714
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuauccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuauacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaagguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggauuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31019 - RNA, 1701 nt, Artificial Sequence
  hemagglutinin__InfluenzaA__ABC41725
augaagacuaccauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31020 - RNA, 1701 nt, Artificial Sequence
  hemagglutinin__InfluenzaA__ABC41736
augaagacuaucauugcuuugagcuacauucuaugccugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31021 - RNA, 1701 nt, Artificial Sequence; identical to SEQ ID NO: 31020
  hemagglutinin__InfluenzaA__ABC41952

SEQ ID NO: 31022 - RNA, 1701 nt, Artificial Sequence
  hemagglutinin__InfluenzaA__ABC41953
augaagacuaucauugcuuugagcuacauucuaugccugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccuguauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31023 - RNA, 1701 nt, Artificial Sequence
  hemagglutinin__InfluenzaA__ABC41964
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuuuaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31024 - RNA, 1701 nt, Artificial Sequence
  hemagglutinin__InfluenzaA__ABC42014
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31025 - RNA, 1701 nt, Artificial Sequence; identical to SEQ ID NO: 31020
  hemagglutinin__InfluenzaA__ABC42114

SEQ ID NO: 31026 - RNA, 1701 nt, Artificial Sequence; identical to SEQ ID NO: 31024
  hemagglutinin__InfluenzaA__ABC42125

SEQ ID NO: 31027 - RNA, 1701 nt, Artificial Sequence; identical to SEQ ID NO: 31024
  hemagglutinin__InfluenzaA__ABC42136

SEQ ID NO: 31028 - RNA, 1701 nt, Artificial Sequence
  hemagglutinin__InfluenzaA__ABC42147
augaagacuaucauugcuuugagcuacauucuaugccugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggauccagacccaggguaagggaugucuccagccgaauaagcaucuauuggacaauaguaaaaccgggagacauacuuuugauuaacagcacagggaaucuaauugcuccucgggguuauuucaaaauacgaagugggaaaagcucaauaaugagaucagauguacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauauggguaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31029 - RNA, 1701 nt, Artificial Sequence; identical to SEQ ID NO: 31024
  hemagglutinin__InfluenzaA__ABC42158

SEQ ID NO: 31030 - RNA, 1701 nt, Artificial Sequence; identical to SEQ ID NO: 31024
  hemagglutinin__InfluenzaA__ABC42169

SEQ ID NO: 31031 - RNA, 1701 nt, Artificial Sequence; identical to SEQ ID NO: 31024
  hemagglutinin__InfluenzaA__ABC42180

SEQ ID NO: 31032 - RNA, 1701 nt, Artificial Sequence; identical to SEQ ID NO: 31024
  hemagglutinin__InfluenzaA__ABC42192

SEQ ID NO: 31033 - RNA, 1701 nt, Artificial Sequence; identical to SEQ ID NO: 31020
  hemagglutinin__InfluenzaA__ABC42307

SEQ ID NO: 31034 - RNA, 1701 nt, Artificial Sequence
  hemagglutinin__InfluenzaA__ABC42318
augaagacuaucauugcuuugagcuacauucuaugccugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcgcccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggaguuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31035 - RNA, 1701 nt, Artificial Sequence; identical to SEQ ID NO: 31024
  hemagglutinin__InfluenzaA__ABC42346

SEQ ID NO: 31036 - RNA, 1701 nt, Artificial Sequence; identical to SEQ ID NO: 31024
  hemagglutinin__InfluenzaA__ABC42461

SEQ ID NO: 31037 - RNA, 1701 nt, Artificial Sequence; identical to SEQ ID NO: 31020
  hemagglutinin__InfluenzaA__ABC42494

SEQ ID NO: 31038 - RNA, 1701 nt, Artificial Sequence; identical to SEQ ID NO: 31024
  hemagglutinin__InfluenzaA__ABC42505

SEQ ID NO: 31039 - RNA, 1701 nt, Artificial Sequence
  hemagglutinin__InfluenzaA__ABC42516
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauaaguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31040 - RNA, 1701 nt, Artificial Sequence; identical to SEQ ID NO: 31020
  hemagglutinin__InfluenzaA__ABC42527

SEQ ID NO: 31041 - RNA, 1701 nt, Artificial Sequence; identical to SEQ ID NO: 31020
  hemagglutinin__InfluenzaA__ABC42574

SEQ ID NO: 31042 - RNA, 1701 nt, Artificial Sequence
  hemagglutinin__InfluenzaA__ABC42585
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggcucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31043 - RNA, 1701 nt, Artificial Sequence; identical to SEQ ID NO: 30822
  hemagglutinin__InfluenzaA__ABC42596

SEQ ID NO: 31044 - RNA, 1701 nt, Artificial Sequence; identical to SEQ ID NO: 30826
  hemagglutinin__InfluenzaA__ABC42607

SEQ ID NO: 31045 - RNA, 1701 nt, Artificial Sequence; identical to SEQ ID NO: 30826
  hemagglutinin__InfluenzaA__ABC42618

SEQ ID NO: 31046 - RNA, 1701 nt, Artificial Sequence
  hemagglutinin__InfluenzaA__ABC42629
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaacgaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacgggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31047 - RNA, 1701 nt, Artificial Sequence
  hemagglutinin__InfluenzaA__ABC42640
augaagacuaucauugcuuugagcuacauucuaugucugguuuucgcucaaaaaauucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31048 - RNA, 1701 nt, Artificial Sequence
  hemagglutinin__InfluenzaA__ABC42651
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31049 - RNA, 1701 nt, Artificial Sequence
  hemagglutinin__InfluenzaA__ABC42662
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggaguuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31050 - RNA, 1701 nt, Artificial Sequence
  hemagglutinin__InfluenzaA__ABC42673
augaagacuaucauugcuuugagcuacauucuaugucugauuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31051 - RNA, 1701 nt, Artificial Sequence; identical to SEQ ID NO: 30822
  hemagglutinin__InfluenzaA__ABC42684

SEQ ID NO: 31052 - RNA, 1701 nt, Artificial Sequence; identical to SEQ ID NO: 30822
  hemagglutinin__InfluenzaA__ABC42695

SEQ ID NO: 31053 - RNA, 1701 nt, Artificial Sequence
  hemagglutinin__InfluenzaA__ABC42706
augaagacuaucauugcuuugagcuacauucuaugucugguuuucgcucaaaaacuucccggaaaugacaacagcacggcaacgcugugccuugggcaccaugcaguaccaaacggaacgacagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 31054 - RNA, 1701 nt, Artificial Sequence; identical to SEQ ID NO: 30822
  hemagglutinin__InfluenzaA__ABC42717

SEQ ID NO: 31055 - RNA, 1701 nt, Artificial Sequence
  hemagglutinin__InfluenzaA__ABC42728
augaagacuaucauugcuuugagcuacauucuaugucugguuuucgcucaaaaacuucccggaaaugacaacagcacggcaacgcugugccuugggcaccaugcaguaccaaacggaacgguagugaaaacaaucacaaaugaccaaauugaaguuacuaaugcuacugagcugguucagaguuccucaacagguggaauaugcgacaguccucaucagauccuugauggagaaaacugcacacuaauggaugcucuauugggagacccucagugugauggcuuccaaaauaagaaaugggaccuuuuuguugaacgcagcagagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaaaaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 31056 - RNA, 1701 nt, Artificial Sequence
  hemagglutinin__InfluenzaA__ABC42739
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcccuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaagauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31057 - RNA, 1698 nt, Artificial Sequence
  hemagglutinin__InfluenzaA__ABC42750
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggaaucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 31058 - RNA, 1701 nt, Artificial Sequence
  hemagglutinin__InfluenzaA__ABC42761
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauaccauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31059 - RNA, 1701 nt, Artificial Sequence
  hemagglutinin__InfluenzaA__ABC42772
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucaccccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaaaguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31060 - RNA, 1701 nt, Artificial Sequence; identical to SEQ ID NO: 30822
  hemagglutinin__InfluenzaA__ABC42783

SEQ ID NO: 31061 - RNA, 1701 nt, Artificial Sequence; identical to SEQ ID NO: 30822
  hemagglutinin__InfluenzaA__ABC42794

SEQ ID NO: 31062 - RNA, 1701 nt, Artificial Sequence; identical to SEQ ID NO: 30822
  hemagglutinin__InfluenzaA__ABC42805

SEQ ID NO: 31063 - RNA, 1701 nt, Artificial Sequence; identical to SEQ ID NO: 30826
  hemagglutinin__InfluenzaA__ABC42816

SEQ ID NO: 31064 - RNA, 1701 nt, Artificial Sequence
  hemagglutinin__InfluenzaA__ABC42827
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaaugagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31065 - RNA, 1701 nt, Artificial Sequence
  hemagglutinin__InfluenzaA__ABC42849
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauagugaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31066 - RNA, 1701 nt, Artificial Sequence
  hemagglutinin__InfluenzaA__ABC42882
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31067 - RNA, 1701 nt, Artificial Sequence; identical to SEQ ID NO: 31066
  hemagglutinin__InfluenzaA__ABC42893

SEQ ID NO: 31068 - RNA, 1701 nt, Artificial Sequence
  hemagglutinin__InfluenzaA__ABC42929
augaagacuaucauugcuuugagcuacauucuaugccugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaaacaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31069 - RNA, 1701 nt, Artificial Sequence; identical to SEQ ID NO: 31024
  hemagglutinin__InfluenzaA__ABC42940

SEQ ID NO: 31070 - RNA, 1701 nt, Artificial Sequence; identical to SEQ ID NO: 31024
  hemagglutinin__InfluenzaA__ABC42951

SEQ ID NO: 31071 - RNA, 1701 nt, Artificial Sequence; identical to SEQ ID NO: 31024
  hemagglutinin__InfluenzaA__ABC42962

SEQ ID NO: 31072 - RNA, 1701 nt, Artificial Sequence; identical to SEQ ID NO: 31020
  hemagglutinin__InfluenzaA__ABC42973

SEQ ID NO: 31073 - RNA, 1701 nt, Artificial Sequence
  hemagglutinin__InfluenzaA__ABC42995
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauucuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31074 - RNA, 1701 nt, Artificial Sequence
  hemagglutinin__InfluenzaA__ABC43006
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauuccaaaugacaaaccauuucaaaauguaaacaggaucacauauggggccugccccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31075 - RNA, 1701 nt, Artificial Sequence
  hemagglutinin__InfluenzaA__ABC43028
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagucaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31076 - RNA, 1701 nt, Artificial Sequence; identical to SEQ ID NO: 31024
  hemagglutinin__InfluenzaA__ABC43039

SEQ ID NO: 31077 - RNA, 1701 nt, Artificial Sequence
  hemagglutinin__InfluenzaA__ABC43050
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccaggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31078 - RNA, 1701 nt, Artificial Sequence; identical to SEQ ID NO: 31024
  hemagglutinin__InfluenzaA__ABC43061

SEQ ID NO: 31079 - RNA, 1701 nt, Artificial Sequence
  hemagglutinin__InfluenzaA__ABC43072
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggcucaaucagaaauggaacuuaugaccaugauguguacagagaugaagcauuaaacaaccgguuccagaucaaagguguugagcugaagucaggauauaaagauuggauccuauggauuuccuuuaccauaucauguuuuuugcuuuguguugcuuuguugggguucaucaugugggccugccaaaaaggcaacauuaggugcaacauuugcauuuga

SEQ ID NO: 31080 - RNA, 1701 nt, Artificial Sequence; identical to SEQ ID NO: 31020
  hemagglutinin__InfluenzaA__ABC43083

SEQ ID NO: 31081 - RNA, 1701 nt, Artificial Sequence
  hemagglutinin__InfluenzaA__ABC43094
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugaguugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31082 - RNA, 1701 nt, Artificial Sequence; identical to SEQ ID NO: 31074
  hemagglutinin__InfluenzaA__ABC43116

SEQ ID NO: 31083 - RNA, 1701 nt, Artificial Sequence; identical to SEQ ID NO: 30822
  hemagglutinin__InfluenzaA__ABC43127

SEQ ID NO: 31084 - RNA, 1701 nt, Artificial Sequence
  hemagglutinin__InfluenzaA__ABC43138
augaagacuaucauugcuuugagcuacauucuaugucugguuuucgcucaaaaacuucccggaaaugacaacagcacggcaacacugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagagaaacaaacuagaggaauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31085 - RNA, 1701 nt, Artificial Sequence; identical to SEQ ID NO: 30822
  hemagglutinin__InfluenzaA__ABC43149

SEQ ID NO: 31086 - RNA, 1701 nt, Artificial Sequence; identical to SEQ ID NO: 30822
  hemagglutinin__InfluenzaA__ABC43160

SEQ ID NO: 31087 - RNA, 1701 nt, Artificial Sequence; identical to SEQ ID NO: 30822
  hemagglutinin__InfluenzaA__ABC43171

SEQ ID NO: 31088 - RNA, 1701 nt, Artificial Sequence; identical to SEQ ID NO: 30822
  hemagglutinin__InfluenzaA__ABC43182

SEQ ID NO: 31089 - RNA, 1701 nt, Artificial Sequence
  hemagglutinin__InfluenzaA__ABC43475
augaagacuaucauugcuuugagcuacauucuaugucugguuuucgcucaaaaacuucccggaaaugacaacagcacggcaacgcugugccuugggcaccaugcaguaccaaacggaacgacagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31090 - RNA, 1701 nt, Artificial Sequence; identical to SEQ ID NO: 30822
  hemagglutinin__InfluenzaA__ABC43486

SEQ ID NO: 31091 - RNA, 1701 nt, Artificial Sequence; identical to SEQ ID NO: 30822
  hemagglutinin__InfluenzaA__ABC43497

SEQ ID NO: 31092 - RNA, 1701 nt, Artificial Sequence
  hemagglutinin__InfluenzaA__ABC43508
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31093 - RNA, 1701 nt, Artificial Sequence; identical to SEQ ID NO: 30826
  hemagglutinin__InfluenzaA__ABC43519

SEQ ID NO: 31094 - RNA, 1701 nt, Artificial Sequence; identical to SEQ ID NO: 30824
  hemagglutinin__InfluenzaA__ABC43530

SEQ ID NO: 31095 - RNA, 1701 nt, Artificial Sequence
  hemagglutinin__InfluenzaA__ABC43552
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguucaucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaccaggaagaaucacagucuccaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31096 - RNA, 1701 nt, Artificial Sequence
  hemagglutinin__InfluenzaA__ABC46554
augaagacuaucauugcuuugagcuacauuuucugucagguuuucgcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaucgaauccuugauggaaaaaacugcacacugauagaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggggucacucaggaugggggaagcuaugcuugcaaaaggggaccugauaacaguuucuucaguagacugaacugguuguacaaaucagaaagcacauauccagugcugaacgugacuaugccaaacaaugacaauuuugacaaacuguacauuugggggguucaccacccgagcacggacaaagaacaaaccaaccuauauguucaagcaucagggagagucacagucuccaccaagagaagccagcaaacuauaaucccgaaugucgggucuagacccuggguaaggggucugucuaguagaauaagcaucuauuggacaauaguaaaaccgggagacauacuguuaauuaauaguaaugggaaccuaauugcuccucgggguuacuucaaaauacgcacugggaaaagcucaauaaugagaucagaugcacccauuggcaccugcaguucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauagggugaucgagaaaacaaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacuaagggaaaaugcugaggacaugggcaauggcugcuucaaaauauaccacaaaugugacaaugcuugcauagggucaaucagaaauggaacuuaugaccaugauguauacagggacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 31097 - RNA, 1701 nt, Artificial Sequence
  hemagglutinin__InfluenzaA__ABC46576
augaagacuaucauugcuuugagcuacauuuucugucugguuuucgcccaaaaccuucccggaaaugacaaaagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugguagaugcucuauugggagacccucauugugauggcuuucagaaugagaaaugggaccuuuuuguugaacgcagcaaagcuuucagcaacuguuacccuuaugaugugccagauuaugccucccuuaggucacuaguugccucgucaggcacccuggaguuuaucaaugaaagcuucaauuggacuggagucacucagagugggggaagcuaugcuugcaaaaggggaucugacaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaagccagcaaacuauaaucccgaauaucgggucuagacccuggguaaggggucugucuagcagaauaagcaucuauuggacaauaguaaaaccgggagacauacuguuaauuaauaguaaugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 31098 - RNA, 1701 nt, Artificial Sequence; identical to SEQ ID NO: 30967
  hemagglutinin__InfluenzaA__ABC50167

SEQ ID NO: 31099 - RNA, 1701 nt, Artificial Sequence; identical to SEQ ID NO: 30967
  hemagglutinin__InfluenzaA__ABC50178

SEQ ID NO: 31100 - RNA, 1701 nt, Artificial Sequence; identical to SEQ ID NO: 30967
  hemagglutinin__InfluenzaA__ABC50189

SEQ ID NO: 31101 - RNA, 1701 nt, Artificial Sequence; identical to SEQ ID NO: 31066
  hemagglutinin__InfluenzaA__ABC50200

SEQ ID NO: 31102 - RNA, 1701 nt, Artificial Sequence; identical to SEQ ID NO: 31066
  hemagglutinin__InfluenzaA__ABC50211

SEQ ID NO: 31103 - RNA, 1701 nt, Artificial Sequence; identical to SEQ ID NO: 31066
  hemagglutinin__InfluenzaA__ABC50222

SEQ ID NO: 31104 - RNA, 1701 nt, Artificial Sequence; identical to SEQ ID NO: 31066
  hemagglutinin__InfluenzaA__ABC50233

SEQ ID NO: 31105 - RNA, 1701 nt, Artificial Sequence; identical to SEQ ID NO: 31066
  hemagglutinin__InfluenzaA__ABC50244

SEQ ID NO: 31106 - RNA, 1701 nt, Artificial Sequence; identical to SEQ ID NO: 31066
  hemagglutinin__InfluenzaA__ABC50266

SEQ ID NO: 31107 - RNA, 1701 nt, Artificial Sequence; identical to SEQ ID NO: 31066
  hemagglutinin__InfluenzaA__ABC50277

SEQ ID NO: 31108 - RNA, 1701 nt, Artificial Sequence
  hemagglutinin__InfluenzaA__ABC50299
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccacaucauguuuuuugcuuuguauuguuuugcugggguucaucaugugggccugccaaaaaggcaacauuaggugcaacauuugcauuuga

SEQ ID NO: 31109 - RNA, 1701 nt, Artificial Sequence
  hemagglutinin__InfluenzaA__ABC50310
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccccauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuuuaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31110 - RNA, 1701 nt, Artificial Sequence
  hemagglutinin__InfluenzaA__ABC50321
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcauugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaacucugaaugcaucacuccaaauggaagcauucccaaugacaaaccauuucaaaauguaaacaggaucacauauggggccugucccagauauguuaagcaaaacacucugaaauuggcaacagggaugcggaaugugccagggaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31111 - RNA, 1701 nt, Artificial Sequence
  hemagglutinin__InfluenzaA__ABC50332
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccugguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauagugaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 31112 - RNA, 1701 nt, Artificial Sequence
  hemagglutinin__InfluenzaA__ABC50343
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagauccgauaaaaguuucuuuaguagauugaauugguugcaccaauuaaaauacaaauauccagcgcugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31113 - RNA, 1701 nt, Artificial Sequence
  hemagglutinin__InfluenzaA__ABC50354
augaagacuaucauugcuuugagcuacauuuuaugccugguuuucgcucaaaaacuccccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccccauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucuucuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuuuaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31114 - RNA, 1701 nt, Artificial Sequence
  hemagglutinin__InfluenzaA__ABC50376
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaccggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31115 - RNA, 1701 nt, Artificial Sequence
  hemagglutinin__InfluenzaA__ABC50387
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacguuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31116 - RNA, 1701 nt, Artificial Sequence
  hemagglutinin__InfluenzaA__ABC50409
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaucaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31117 - RNA, 1701 nt, Artificial Sequence; identical to SEQ ID NO: 31116
  hemagglutinin__InfluenzaA__ABC50420

SEQ ID NO: 31118 - RNA, 1701 nt, Artificial Sequence
  hemagglutinin__InfluenzaA__ABC54668
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggaacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagccuucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31119 - RNA, 1701 nt, Artificial Sequence
  hemagglutinin__InfluenzaA__ABC54679
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccccaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuaccccuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaaugucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucgaucagaaauggaacuuaugaccaugauguauacagagaugaggcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31120 - RNA, 1701 nt, Artificial Sequence; identical to SEQ ID NO: 31020
  hemagglutinin__InfluenzaA__ABC67319

SEQ ID NO: 31121 - RNA, 1701 nt, Artificial Sequence
  hemagglutinin__InfluenzaA__ABC67454
augaagacuaucauugcuuugagcuacauuuuaugccugguuuucgcucaagaacuucccggaaaugacaacagcacggcaacgcugugucuggggcaucaugcagugccaaacggaacgcuagugaaaacaaucacuaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31122 - RNA, 1701 nt, Artificial Sequence
  hemagglutinin__InfluenzaA__ABC67471
augaagacuaucauugcuuugagcuacauucuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31123 - RNA, 1701 nt, Artificial Sequence
  hemagglutinin__InfluenzaA__ABC67554
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauucccagcagaauaagcaucuauuggacaauaguaaaaccgggagacauacuuuugauuaacagcacagggaaucuaauugcuccucgggguuacuuuaaaauacgaagugggaaaagcucaauaaugagaucagaugcacccauugucaaaugcaauucugaaugcauuacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31124 - RNA, 1701 nt, Artificial Sequence
  hemagglutinin__InfluenzaA__ABC67565
augaagacuaucauugcuuugagcuacauuuucugucugguucucggccaagacuuuccaggaaaugacaacagcacagcaacgcugugccuggggcaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauaucgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31125 - RNA, 1701 nt, Artificial Sequence
  hemagglutinin__InfluenzaA__ABC67576
augaagacuaucauugcuuugagcuacauuuuaugucugguuuucgcucaaaaacuucccggaaaugacaacagcauggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacgaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaagcaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31126 - RNA, 1701 nt, Artificial Sequence
  hemagglutinin__InfluenzaA__ABC67587
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31127 - RNA, 1701 nt, Artificial Sequence; identical to SEQ ID NO: 30822
  hemagglutinin__InfluenzaA__ABC67598

SEQ ID NO: 31128 - RNA, 1701 nt, Artificial Sequence
  hemagglutinin__InfluenzaA__ABC67609
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucaccccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31129 - RNA, 1701 nt, Artificial Sequence; identical to SEQ ID NO: 31066
  hemagglutinin__InfluenzaA__ABC67620

SEQ ID NO: 31130 - RNA, 1701 nt, Artificial Sequence; identical to SEQ ID NO: 31066
  hemagglutinin__InfluenzaA__ABC67631

SEQ ID NO: 31131 - RNA, 1701 nt, Artificial Sequence; identical to SEQ ID NO: 31066
  hemagglutinin__InfluenzaA__ABC67642

SEQ ID NO: 31132 - RNA, 1701 nt, Artificial Sequence
  hemagglutinin__InfluenzaA__ABC67653
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacgcuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguguuguuuugcugggguucaucaugugggccugccaaaaaggcaacauuaggugcaacauuugcauuuga

SEQ ID NO: 31133 - RNA, 1701 nt, Artificial Sequence
  hemagglutinin__InfluenzaA__ABC67697
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31134 - RNA, 1701 nt, Artificial Sequence
  hemagglutinin__InfluenzaA__ABC67708
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuaccgagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31135 - RNA, 1701 nt, Artificial Sequence
  hemagglutinin__InfluenzaA__ABC67719
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaaguauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcagagcuucuuguugcccuggagaaucaacauacaauugaucuaacugacucagaaaugaacaaacuauuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31136 - RNA, 1701 nt, Artificial Sequence; identical to SEQ ID NO: 31135
  hemagglutinin__InfluenzaA__ABC67733

SEQ ID NO: 31137 - RNA, 1701 nt, Artificial Sequence
  hemagglutinin__InfluenzaA__ABC67806
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31138 - RNA, 1701 nt, Artificial Sequence; identical to SEQ ID NO: 31024
  hemagglutinin__InfluenzaA__ABC67817

SEQ ID NO: 31139 - RNA, 1701 nt, Artificial Sequence
  hemagglutinin__InfluenzaA__ABC67828
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31140 - RNA, 1701 nt, Artificial Sequence; identical to SEQ ID NO: 30998
  hemagglutinin__InfluenzaA__ABC67839

SEQ ID NO: 31141 - RNA, 1701 nt, Artificial Sequence
  hemagglutinin__InfluenzaA__ABC67850
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccugggcaaggggugucuccagcagaauaagcauccauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31142 - RNA, 1701 nt, Artificial Sequence; identical to SEQ ID NO: 30998
  hemagglutinin__InfluenzaA__ABC67861

SEQ ID NO: 31143 - RNA, 1701 nt, Artificial Sequence; identical to SEQ ID NO: 31066
  hemagglutinin__InfluenzaA__ABC67883

SEQ ID NO: 31144 - RNA, 1701 nt, Artificial Sequence
  hemagglutinin__InfluenzaA__ABC67894
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcaguaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguaaauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31145 - RNA, 1701 nt, Artificial Sequence; identical to SEQ ID NO: 31066
  hemagglutinin__InfluenzaA__ABC67967

SEQ ID NO: 31146 - RNA, 1701 nt, Artificial Sequence; identical to SEQ ID NO: 31066
  hemagglutinin__InfluenzaA__ABC67978

SEQ ID NO: 31147 - RNA, 1701 nt, Artificial Sequence
  hemagglutinin__InfluenzaA__ABC67989
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaaagugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugucugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31148 - RNA, 1701 nt, Artificial Sequence
  hemagglutinin__InfluenzaA__ABC68000
augaagacuaucauugcuuugagcuacauuuuaugccugguuuucgcucaagaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31149 - RNA, 1701 nt, Artificial Sequence
  hemagglutinin__InfluenzaA__ABC68049
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacggaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacguuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31150 - RNA, 1701 nt, Artificial Sequence; identical to SEQ ID NO: 31066
  hemagglutinin__InfluenzaA__ABC68060

SEQ ID NO: 31151 - RNA, 1701 nt, Artificial Sequence
  hemagglutinin__InfluenzaA__ABC68071
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugagguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccauaauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31152 - RNA, 1701 nt, Artificial Sequence
  hemagglutinin__InfluenzaA__ABC68082
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauauaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31153 - RNA, 1701 nt, Artificial Sequence
  hemagglutinin__InfluenzaA__ABC68093
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggcaugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccacaucauguuuuuugcuuuguauuguuuuacugggguucaucaugugggccugccaaaaaggcaacauuaggugcaacauuugcauuuga

SEQ ID NO: 31154 - RNA, 1701 nt, Artificial Sequence
  hemagglutinin__InfluenzaA__ABC68222
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31155 - RNA, 1701 nt, Artificial Sequence; identical to SEQ ID NO: 30946
  hemagglutinin__InfluenzaA__ABC68233

SEQ ID NO: 31156 - RNA, 1707 nt, Artificial Sequence
  hemagglutinin__InfluenzaA__ABC72655
auggagaaaauagugcuucuuuuugcaauagucagucuuguuaaaagugaucagauuugcauugguuaccaugcaaacaacucaacagagcagguugacacaauaauggaaaagaacguuacuguuacacaugcccaagacauacuggaaaagacacacaacgggaagcucugugaucuagauggagugaagccucuaauuuugagagauuguaguguagcuggauggcuccuuggaaacccaaugugugaugaauucaucaaugugccggaauggucuuacauaguggagaagcccaauccagccaaugaccucuguuacccaggggauuucaaugacuaugaagaauugaaacaccuauugagcagaauaaaccauuuugagaaaauucagaucauccccaaaaguucuugguccagucaugaagccucaguaggagugagcucaguauguccauaucagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuacauuuccguugggacaucaacacuaaaccagagauugguaccaagaauagcuacuagauccaaaguaaacgggcaaaguggacggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauacgguaacugcaacaccaagugucaaacuccaaugggggcgauaaacucuaguaugccauuccacaauauacacccucucaccaucggggaaugccccaaauaugugaaaucaaacagauuaguccuugcgacuggacucagaaauagcccucaaagagagaaaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaaucuaaacaagaagauggaagacggguuccuagaugucuggacuuauaaugcugaacuucugguucucauggaaaaugagagaacucuagacuuucaugacucaaaugucaagaaccuuuacgacaagguccgauuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 31157 - RNA, 1701 nt, Artificial Sequence
  hemagglutinin__InfluenzaA__ABC84400
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugccccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaauugcggguuucauagaaaaugguugggagggaaugguugaugguugguacgguuucaggcaucaaaauucugagggaauaggacaagcagcagaucucaaaagcacucaagcagcaaucaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31158 - RNA, 1701 nt, Artificial Sequence
  hemagglutinin__InfluenzaA__ABC84411
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaccaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31159 - RNA, 1701 nt, Artificial Sequence
  hemagglutinin__InfluenzaA__ABC84433
augaagacuaucauugcuuugagcuacauucuaugucugguuuucgcucaaaaacuucccggaaaugacaacagaacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31160 - RNA, 1701 nt, Artificial Sequence; identical to SEQ ID NO: 31066
  hemagglutinin__InfluenzaA__ABC84444

SEQ ID NO: 31161 - RNA, 1701 nt, Artificial Sequence
  hemagglutinin__InfluenzaA__ABC84498
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31162 - RNA, 1701 nt, Artificial Sequence; identical to SEQ ID NO: 31161
  hemagglutinin__InfluenzaA__ABC84509

SEQ ID NO: 31163 - RNA, 1701 nt, Artificial Sequence
  hemagglutinin__InfluenzaA__ABC84520
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaagggauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31164 - RNA, 1701 nt, Artificial Sequence
  hemagglutinin__InfluenzaA__ABC84531
augaagacuaucauugcuuugagcuacauuuucugucugguuuucgcccaaaaacuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaaagcaaauauccagcgcugaacgugacuaugccaaacaauggcagauuugacaaauuguacauuugggggguucaccacccgagcacggacaaagaacaaaccaaccuauauguucgagcagcagggagagucacagucucuaccaagagaagccagcaaacuguaaucccgaauaucgggucuagacccuggguaaggggucugucuaguagaauaagcaucuauuggacaauaguaaaaccgggagacauacuguugauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaaacaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauaggaucaaucagaaauggaacuuaugaccaugauguauacagagacgaagcauugaacaaccgguuucagaucaaagguguugagcugaagucaggauacaaagacuggauccuauggauuuccuuugccauaucaugcuuuuuacuuuguguuguuuugcugggguucaucaugugggccugccaaaaaggcaacauuaggugcaacauuugcauuuga

SEQ ID NO: 31165 - RNA, 1701 nt, Artificial Sequence; identical to SEQ ID NO: 31154
  hemagglutinin__InfluenzaA__ABC84560

SEQ ID NO: 31166 - RNA, 1701 nt, Artificial Sequence
  hemagglutinin__InfluenzaA__ABC84571
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaaucauugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuauuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31167 - RNA, 1701 nt, Artificial Sequence; identical to SEQ ID NO: 31154
  hemagglutinin__InfluenzaA__ABC85754

SEQ ID NO: 31168 - RNA, 1701 nt, Artificial Sequence; identical to SEQ ID NO: 31139
  hemagglutinin__InfluenzaA__ABC85765

SEQ ID NO: 31169 - RNA, 1701 nt, Artificial Sequence
  hemagglutinin__InfluenzaA__ABC85776
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacuucacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31170 - RNA, 1701 nt, Artificial Sequence; identical to SEQ ID NO: 31154
  hemagglutinin__InfluenzaA__ABC85787

SEQ ID NO: 31171 - RNA, 1701 nt, Artificial Sequence; identical to SEQ ID NO: 31137
  hemagglutinin__InfluenzaA__ABC85798

SEQ ID NO: 31172 - RNA, 1701 nt, Artificial Sequence; identical to SEQ ID NO: 31139
  hemagglutinin__InfluenzaA__ABC85820

SEQ ID NO: 31173 - RNA, 1701 nt, Artificial Sequence; identical to SEQ ID NO: 31135
  hemagglutinin__InfluenzaA__ABC85831

SEQ ID NO: 31174 - RNA, 1701 nt, Artificial Sequence
  hemagglutinin__InfluenzaA__ABC85842
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaucacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31175 - RNA, 1701 nt, Artificial Sequence; identical to SEQ ID NO: 31139
  hemagglutinin__InfluenzaA__ABC85853

SEQ ID NO: 31176 - RNA, 1701 nt, Artificial Sequence; identical to SEQ ID NO: 31135
  hemagglutinin__InfluenzaA__ABC85864

SEQ ID NO: 31177 - RNA, 1701 nt, Artificial Sequence
  hemagglutinin__InfluenzaA__ABC85886
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucaugcuuuuugcuuuguguugcuuuguugggguucaucaugugggccugccaaaaaggcaacauuaggugcaacauuugcauuuga

SEQ ID NO: 31178 - RNA, 1701 nt, Artificial Sequence; identical to SEQ ID NO: 31066
  hemagglutinin__InfluenzaA__ABC85908

SEQ ID NO: 31179 - RNA, 1701 nt, Artificial Sequence
  hemagglutinin__InfluenzaA__ABC85919
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaaggugucgagcugaagucaggauacaaagauuggguccuauggauuuccuuugccauaucauguuuuuugcuuuguauuguuuugaugggguucaucaugugggccugccaaaaaggcaacauuaggugcaacauuugcauuuga

SEQ ID NO: 31180 - RNA, 1701 nt, Artificial Sequence; identical to SEQ ID NO: 31109
  hemagglutinin__InfluenzaA__ABC85930

SEQ ID NO: 31181 - RNA, 1701 nt, Artificial Sequence; identical to SEQ ID NO: 31115
  hemagglutinin__InfluenzaA__ABC85941

SEQ ID NO: 31182 - RNA, 1701 nt, Artificial Sequence
  hemagglutinin__InfluenzaA__ABC85952
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaagaaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucauaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31183 - RNA, 1701 nt, Artificial Sequence; identical to SEQ ID NO: 31066
  hemagglutinin__InfluenzaA__ABC85974

SEQ ID NO: 31184 - RNA, 1701 nt, Artificial Sequence; identical to SEQ ID NO: 31066
  hemagglutinin__InfluenzaA__ABC85985

SEQ ID NO: 31185 - RNA, 1701 nt, Artificial Sequence
  hemagglutinin__InfluenzaA__ABC85996
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugauggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31186 - RNA, 1701 nt, Artificial Sequence; identical to SEQ ID NO: 30822
  hemagglutinin__InfluenzaA__ABC86007

SEQ ID NO: 31187 - RNA, 1701 nt, Artificial Sequence
  hemagglutinin__InfluenzaA__ABC86018
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacaauaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31188 - RNA, 1701 nt, Artificial Sequence; identical to SEQ ID NO: 30822
  hemagglutinin__InfluenzaA__ABC86029

SEQ ID NO: 31189 - RNA, 1701 nt, Artificial Sequence; identical to SEQ ID NO: 30826
  hemagglutinin__InfluenzaA__ABC86040

SEQ ID NO: 31190 - RNA, 1701 nt, Artificial Sequence; identical to SEQ ID NO: 31020
  hemagglutinin__InfluenzaA__ABC86124

SEQ ID NO: 31191 - RNA, 1701 nt, Artificial Sequence
  hemagglutinin__InfluenzaA__ABC86137
augaagacuaucauugcuuugagcuacauuuucugucugguuuucgcccaaaaccuucccggaaaugacaaaagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugguagaugcucuauugggagacccucauugugauggcuuucagaaugagaaaugggaccuuuuuguugaacgcagcaaagcuuucagcaacuguuacccuuaugaugugccagauuaugccucccuuaggucacuaguugccucgucaggcacccuggaguuuaucaaugaaagcuucaauuggacuggagucacucagagugggggaagcuaugcuugcaaaaggggaucugauaacaguuucuucaguagacugaauugguuguacgaaucagaaagcaaauauccagugcugaacgugacuaugccaaacaauggcaauuuugacaaacuguacauuugggggguucaccacccgagcacggacaaagaacaaaccaaccuauauguucgagcaucagggagagucacagucucuaccaagagaagccagcaaacuauaaucccgaauaucgggucuagacccuggguaaggggucugucuagcagaauaagcaucuauuggacaauaguaaaaccgggagacauacuguuaauuaauaguaaugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaauguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaaugggaaacugaauaggguaaucgagaaaacgaacgagaaauuccaucaaaucgaaaaggaauucucagaaguagaagggagaauucaggaccucgagaaauacguugaagacacuaaaauagaucucuggucuuacaacgcggaacuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 31192 - RNA, 1701 nt, Artificial Sequence
  hemagglutinin__InfluenzaA__ABC97374
augaagacuaucauugcuuugagcuacauuuucugucugguucucggccaagacuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugguagacgguugguacgguuucaggcaucaaaauucugagggcacaggacaagcagcagaucuuaaaaguacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucagaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31193 - RNA, 1701 nt, Artificial Sequence; identical to SEQ ID NO: 30536
  hemagglutinin__InfluenzaA__ABD15449

SEQ ID NO: 31194 - RNA, 1701 nt, Artificial Sequence
  hemagglutinin__InfluenzaA__ABD15460
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccuuaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuucagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31195 - RNA, 1701 nt, Artificial Sequence
  hemagglutinin__InfluenzaA__ABD15471
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaagaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31196 - RNA, 1701 nt, Artificial Sequence; identical to SEQ ID NO: 30540
  hemagglutinin__InfluenzaA__ABD15482

SEQ ID NO: 31197 - RNA, 1701 nt, Artificial Sequence; identical to SEQ ID NO: 31194
  hemagglutinin__InfluenzaA__ABD15493

SEQ ID NO: 31198 - RNA, 1701 nt, Artificial Sequence; identical to SEQ ID NO: 30771
  hemagglutinin__InfluenzaA__ABD15526

SEQ ID NO: 31199 - RNA, 1701 nt, Artificial Sequence
  hemagglutinin__InfluenzaA__ABD15537
augaagacuaucauugcuuugagcuacauuucaugucugguuuucgcucaaaaacuucccggaaaugacaacagcacggcaacgcugugccugggacaccaugcagugccaaacggaacacuagugaaaacaaucacaaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31200 - RNA, 1701 nt, Artificial Sequence; identical to SEQ ID NO: 30967
  hemagglutinin__InfluenzaA__ABD15548

SEQ ID NO: 31201 - RNA, 1701 nt, Artificial Sequence
  hemagglutinin__InfluenzaA__ABD15559
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcagagcuucuuguugcccuggagaaccaacauacaauugaucuaacugacucagaaaugaacaaacuguuugaaagaacaaggaagcaacuaagggaaaaugcugaggauaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31202 - RNA, 1701 nt, Artificial Sequence; identical to SEQ ID NO: 30967
  hemagglutinin__InfluenzaA__ABD15570

SEQ ID NO: 31203 - RNA, 1701 nt, Artificial Sequence; identical to SEQ ID NO: 31006
  hemagglutinin__InfluenzaA__ABD15581

SEQ ID NO: 31204 - RNA, 1701 nt, Artificial Sequence
  hemagglutinin__InfluenzaA__ABD15592
augaagacuaucauugcuuugagcuacauuucaugucugguuuucgcucaaaaacuucccggaaaugacaacagcacggcaacgcugugccugggacaccaugcagugccaaacggaacacuagugaaaacaaucacaaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuagaugcaacauuugcauuuga

SEQ ID NO: 31205 - RNA, 1701 nt, Artificial Sequence; identical to SEQ ID NO: 30967
  hemagglutinin__InfluenzaA__ABD15603

SEQ ID NO: 31206 - RNA, 1701 nt, Artificial Sequence
  hemagglutinin__InfluenzaA__ABD15614
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccucgauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacucuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31207 - RNA, 1701 nt, Artificial Sequence
  hemagglutinin__InfluenzaA__ABD15625
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccaaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgugaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31208 - RNA, 1701 nt, Artificial Sequence
  hemagglutinin__InfluenzaA__ABD15636
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacuaagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31209 - RNA, 1701 nt, Artificial Sequence
  hemagglutinin__InfluenzaA__ABD15680
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaaccagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggauucaucaugugggccugccaaaaaggcaacauuaggugcaacauuugcauuuga

SEQ ID NO: 31210 - RNA, 1701 nt, Artificial Sequence
  hemagglutinin__InfluenzaA__ABD15691
augaagacuaucauugcuuugagcuacauuuuaugucugguuuucgcucaaaaacuucccguaaaugacaaaagcacggcaacgcugugccugggacaccaugcagugccaaacggaacgcuagugaaaacaaucacgaaugaccacauugaagugacuaaugcuacugagcugguucagaguuccccaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcagguuucauagaaaaugguugggaaggaaugguggacgguugguacgguuucaggcaucaaaauucugagggcacaggacaagcagcagaucuuaaaagcacucaagcugcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31211 - RNA, 1701 nt, Artificial Sequence
  hemagglutinin__InfluenzaA__ABD15702
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaccagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuauuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31212 - RNA, 1701 nt, Artificial Sequence
  hemagglutinin__InfluenzaA__ABD15724
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacguggcuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31213 - RNA, 1701 nt, Artificial Sequence
  hemagglutinin__InfluenzaA__ABD15746
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugaguugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaagggguaucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcggaauguaccagagaaacaaacuagaggcauauucggcgcaaucgcggguuucauagaaaaugguugggagggaaugguagacgguugguaugguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacagacucagaaaugaacaaacuguuugaaagaacaaggaagcaacugagggaaaaugcugaggagaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31214 - RNA, 1701 nt, Artificial Sequence
  hemagglutinin__InfluenzaA__ABD15757
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugaguugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcggaauguaccagagaaacaaacuagaggcauauucggcgcaaucgcggguuucauagaaaaugguugggagggaaugguagacgguugguaugguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacagacucagaaaugaacaaacuguuugaaagaacaaggaagcaacugagggaaaaugcugaggagaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31215 - RNA, 1701 nt, Artificial Sequence; identical to SEQ ID NO: 31154
  hemagglutinin__InfluenzaA__ABD15779

SEQ ID NO: 31216 - RNA, 1701 nt, Artificial Sequence; identical to SEQ ID NO: 31154
  hemagglutinin__InfluenzaA__ABD15790

SEQ ID NO: 31217 - RNA, 1701 nt, Artificial Sequence; identical to SEQ ID NO: 31154
  hemagglutinin__InfluenzaA__ABD16292

SEQ ID NO: 31218 - RNA, 1701 nt, Artificial Sequence; identical to SEQ ID NO: 31177
  hemagglutinin__InfluenzaA__ABD16303

SEQ ID NO: 31219 - RNA, 1701 nt, Artificial Sequence
  hemagglutinin__InfluenzaA__ABD16325
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgaaaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauucuauggauuuccuuugccauaucauguuuuuugcuuuguguugcuuuguugggguucaucaugugggccugccaaaaaggcaacauuaggugcaacauuugcauuuga

SEQ ID NO: 31220 - RNA, 1701 nt, Artificial Sequence
  hemagglutinin__InfluenzaA__ABD16336
augaagacuaucauugcuuugagcuacacucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucagacaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31221 - RNA, 1701 nt, Artificial Sequence; identical to SEQ ID NO: 31137
  hemagglutinin__InfluenzaA__ABD16347

SEQ ID NO: 31222 - RNA, 1701 nt, Artificial Sequence
  hemagglutinin__InfluenzaA__ABD16358
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacaccaaaauagaucucuggucauacaacgcggagcuucuuguugcccuagagaaccaacauacaauugaucuaacugacuuagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31223 - RNA, 1701 nt, Artificial Sequence
  hemagglutinin__InfluenzaA__ABD16472
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaacgccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31224 - RNA, 1701 nt, Artificial Sequence; identical to SEQ ID NO: 31137
  hemagglutinin__InfluenzaA__ABD16483

SEQ ID NO: 31225 - RNA, 1701 nt, Artificial Sequence; identical to SEQ ID NO: 31139
  hemagglutinin__InfluenzaA__ABD16494

SEQ ID NO: 31226 - RNA, 1701 nt, Artificial Sequence; identical to SEQ ID NO: 31161
  hemagglutinin__InfluenzaA__ABD16505

SEQ ID NO: 31227 - RNA, 1701 nt, Artificial Sequence
  hemagglutinin__InfluenzaA__ABD16516
augaagacuaucauugcuuugagcuacauucuauguaugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugauguaccggauuaugccucccuuagaucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaacaucggaucuagacccaggguaagggauauucccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauugacaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaguagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaaccuaugaccaugauguauacagagaugaagcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31228 - RNA, 1701 nt, Artificial Sequence
  hemagglutinin__InfluenzaA__ABD16527
augaagacuaucauugcuuugagcuacauucuaugucugguuuucgcucaaaaacuucccgaaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 31229 - RNA, 1701 nt, Artificial Sequence; identical to SEQ ID NO: 31020
  hemagglutinin__InfluenzaA__ABD16538

SEQ ID NO: 31230 - RNA, 1701 nt, Artificial Sequence
  hemagglutinin__InfluenzaA__ABD16549
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuacgccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucgugugggccugccaaaaaggcaacauuaggugcaacauuugcauuuga

SEQ ID NO: 31231 - RNA, 1701 nt, Artificial Sequence; identical to SEQ ID NO: 31135
  hemagglutinin__InfluenzaA__ABD16560

SEQ ID NO: 31232 - RNA, 1701 nt, Artificial Sequence
  hemagglutinin__InfluenzaA__ABD16571
augaagaccaucauugcuuugagcuacauuuucugucugguugucgcccaaaaacuucccggaaaugacaacagcacagcaacgcugugccugggacaucaugcagugccaaacggaacgauagugaaaacaaucacgaaugaccaaauugaagugacuaaugcuacugagcugguccagaguuccucaacaggucgaauaugcaacaguccucaccgaauccuugauggaaaaaacugcacacugauagaugcucuauugggagacccucauugugauagcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucuccaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaaugugccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 31233 - RNA, 1701 nt, Artificial Sequence
  hemagglutinin__InfluenzaA__ABD16718
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuauugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaauacaaauauccagcgcugaacgugacuaugccaaacaauggcaaauuugacaaacuguacauuugggggguucaccacccgaucacggaaaaagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacggaaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 31234 - RNA, 1701 nt, Artificial Sequence
  hemagglutinin__InfluenzaA__ABD16729
augaagacuaucauugcuuugagcuacauuuucugucugguuuucgcccaaaaacuucccggaaaugacaacagcacagcaacgcugugcuugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcaccuuggaguuuaucaaugaaggcuucaauuggacuggagucacucagaaugggggaagcuauacuugcaaaagaggaucuguuaacaguuucuucaguagauugaauugguuguacgaaucagaaagcaaauauccagugcugaacgugacuaugccaaauaauggcaaauuugacaaauuguacauuugggggguucaccacccgagcacggacaaagaacaaaccaacuuauauguucgagcaucagggaaagucacagucucuaccaagagaagccagcaaacuguaaucccgaauaucgggucuagacccuggguaaggggucugucuaguagaauaaguaucuauuggacaauaguaaaaccgggagacauacuguuaauuaauagcacuggaaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggagcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaacagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugauucagaaaugaacaaacuguuugaaaaaacaaggaaacaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 31235 - RNA, 1701 nt, Artificial Sequence
  hemagglutinin__InfluenzaA__ABD16751
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucauaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31236 - RNA, 1701 nt, Artificial Sequence; identical to SEQ ID NO: 31191
  hemagglutinin__InfluenzaA__ABD16762

SEQ ID NO: 31237 - RNA, 1701 nt, Artificial Sequence
  hemagglutinin__InfluenzaA__ABD17323
augaagacuaucauugcuuugagcuacauuuucugucugguucucggccaagacuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucaggaagcacauauccagugcugaaugugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccgggggacauacugguaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31238 - RNA, 1701 nt, Artificial Sequence; identical to SEQ ID NO: 31066
  hemagglutinin__InfluenzaA__ABD38134

SEQ ID NO: 31239 - RNA, 1698 nt, Artificial Sequence
  hemagglutinin__InfluenzaA__ABD60779
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugaaaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuauaucucuguagugucuucacauuauagcagaagauucaccccagaaauagccaaaagacccaagguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaagauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31240 - RNA, 1701 nt, Artificial Sequence
  hemagglutinin__InfluenzaA__ABD60790
augaagacuaucauugcuuugagcuacauuuucugucugguucucggccaagacuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcuuuauugggggacccucauugugauggcuuucaaaaugagacaugggaccuuuucguugaacgcagcaaagcuuucagcaacuguuacccuuaugaugugccagauuaugccucccucaggucacuaguugccucgucaggcacucuggaguuuaucaaugaaggcuucacuuggacuggggucacucagaaugggggaagcaaugcuugcaaaaggggaccugauagcgguuuuuucaguagacugaacugguuguacaaaucgggaagcacauauccagugcugaacgugacuaugccaaacaaugacaauuuugacaaacuauacauuugggggguucaccacccgagcacggaccaagaacaaaccagccuauauguucaagcaucagggagagucacagucuccaccaagagaagccagcaaacuauaaucccgaauaucgggucuagacccuggguaaggggucugucuaguagaauaagcaucuauuggacaauaguuaaaccgggagacauacugauaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggauaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31241 - RNA, 1701 nt, Artificial Sequence
  hemagglutinin__InfluenzaA__ABD60801
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagacuaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcagaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucaguccaguagaaugagcaucuauuggacaauaguaaaaccgggagacauacuuuugauuaauagcacagggaaucuaauugcuccucgggguuacuucaaaauacgaaaugggaaaagcucaauaaugagaucagaugcacccauuggcaacugcaguucugaaugcaucacuccaaauggaagcauucccaaugacaaaccuuuucaaaauguaaacaggaucacauauggggccugccccagauauguuaagcaacacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacggacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcuaaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31242 - RNA, 1701 nt, Artificial Sequence
  hemagglutinin__InfluenzaA__ABD60812
augaagacuaucauugcuuugagcuacauucuaugucugauuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaguaucgguucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31243 - RNA, 1701 nt, Artificial Sequence; identical to SEQ ID NO: 31161
  hemagglutinin__InfluenzaA__ABD60823

SEQ ID NO: 31244 - RNA, 1701 nt, Artificial Sequence
  hemagglutinin__InfluenzaA__ABD60845
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccccauugugauggcuuccaaaauaaggaaugggaccuuuuuguugaacgcagcacagccuacagcaacuguuacccuuaugaugugccggauuaugccucccuuaggucacuaguugccucauccggcacacuugaguuuaacaaugaaagcuucaauuggacuggagucgaucagaauggaacaagcucugcuugcaaaaggagaucuacuaaaaguuucuuuaguagauugaauugguugcaccaauuaaaauacaaauauccagcacugaacgugacuaugccaaacaaugaaaaauuugacaaauuguacauuugggggguucaccauccgaguacggacagugaccaaaucagccuauaugcucaagcaucagggagagucacagucucuaccaaaagaagccaacaaacuguaaccccgaauaucggaucuagacccuggguaaggggugucuccagcagaauaagcauuuauuggacaauaguaaaaccgggagacauacuuuugauuaacagcacagggaaucuaauugcuccucgggguuacuucaaaauacgaagugggaaaagcucaauaaugaggucaaaugcacucauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaaacaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31245 - RNA, 1698 nt, Artificial Sequence
  hemagglutinin__InfluenzaA__ABD60878
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaaaggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31246 - RNA, 1698 nt, Artificial Sequence
  hemagglutinin__InfluenzaA__ABD60889
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31247 - RNA, 1698 nt, Artificial Sequence
  hemagglutinin__InfluenzaA__ABD60900
augaaaguaaaacgacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaaaggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31248 - RNA, 1698 nt, Artificial Sequence
  hemagglutinin__InfluenzaA__ABD60911
augaaagcaaaacuaaugguccuguuauguacauuuacagcuacauaugcagacacaauauguaucggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaacugcagcguugccggauggaucuuaggaaacccagaaugcgaauuacugauuuccaaggaaucaugguccuacauuguagaaacaccaaauccugagaauggaacauguuacccaggauauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauugacgggauuacaaacaaggugaauucuauaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucguugcaguguagaauaugcaucuga

SEQ ID NO: 31249 - RNA, 1701 nt, Artificial Sequence
  hemagglutinin__InfluenzaA__ABD60922
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagagaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31250 - RNA, 1701 nt, Artificial Sequence
  hemagglutinin__InfluenzaA__ABD60933
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacugguuucuaagaaaucaugguccuacauugcagaaacaccaaacuccgagaauggaacauguuacccaggauauuucgccgacuaugaggaauugagggagcaauugagcucaguaucaucauucgagagauucgaaauauuccccaaggaaagaucauggcccaaacacaacguaaccagaggcguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcagaaagacccaaaguaagaggucaagcagggagaauuaacuacuacuggacucugcuggaacccggggacacaauaauauuugaggcaaauggaaaucuaauagcgccauggcaugcuuucgcacugaauagaggcuuugggucaggaaucaucaccucaaacgcaucgauggaugaaugugacacgaagugucaaacaccccagggagcuauaaacaguagucuuccuuuccagaauauacacccagucacaauaggggagugcccaaaauacgucaggaguacaaaauugaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31251 - RNA, 1701 nt, Artificial Sequence
  hemagglutinin__InfluenzaA__ABD60944
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcagaaagacccaaaguaagaggucaagcagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagucuuccuuuccagaauguacacccagucacaauaggagagugcccaaaauacgucaggaguacaaaauuaaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31252 - RNA, 1701 nt, Artificial Sequence
  hemagglutinin__InfluenzaA__ABD60955
augaaagcaaaacuacuaguccuguuaugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugucgacuaaagggaauagccccacuacaauuggguaauugcagcguugccggauggaucuuaggaaacccaaaaugcgaaucacuguuuucuaaggaaucaugguccuacauugcagaaacaccaaacccugagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacgacaucaugcucccauaaugggaaaagcaguuuuuacagaaauuugcuauggcugacggagaagaauggcuuguacccaaaucugagcaaguccuauguaaacaacaaagagaaagaaguccuuguacuaugggguguucaucacccgucuaacauaagggaccaaagggccaucuaucauacagaaaaugcuuaugucucuguagugucuucacauuauagcagaagauucaccccagaaauagcaaaaagacccaaaguaagagaucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaccaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaauggaaggacuuuggauuuucaugacucaaaugugaagaaucuguaugagaaaguaaaaagccaauugaagaauaaugccaaagaaauagggaacggguguuuugaauucuaucacaaguguaacaaugaaugcauggaaagugugaaaaauggaacuuaugacuauccaaaauauuccgaagaaucaaaguuaaacaggggaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 31253 - RNA, 1701 nt, Artificial Sequence
  hemagglutinin__InfluenzaA__ABD61260
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31254 - RNA, 1701 nt, Artificial Sequence
  hemagglutinin__InfluenzaA__ABD61271
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaucacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagagaugaacaaacuguuugaaagaacaaagaagcaacugagagaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31255 - RNA, 1701 nt, Artificial Sequence; identical to SEQ ID NO: 30790
  hemagglutinin__InfluenzaA__ABD61282

SEQ ID NO: 31256 - RNA, 1701 nt, Artificial Sequence; identical to SEQ ID NO: 31024
  hemagglutinin__InfluenzaA__ABD61293

SEQ ID NO: 31257 - RNA, 1701 nt, Artificial Sequence; identical to SEQ ID NO: 31242
  hemagglutinin__InfluenzaA__ABD61304

SEQ ID NO: 31258 - RNA, 1701 nt, Artificial Sequence; identical to SEQ ID NO: 31154
  hemagglutinin__InfluenzaA__ABD61315

SEQ ID NO: 31259 - RNA, 1701 nt, Artificial Sequence
  hemagglutinin__InfluenzaA__ABD61337
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31260 - RNA, 1701 nt, Artificial Sequence
  hemagglutinin__InfluenzaA__ABD61348
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccauccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaauaacaaaccauuucaaaauguaaacaggaucacauauggggcaugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31261 - RNA, 1701 nt, Artificial Sequence; identical to SEQ ID NO: 30794
  hemagglutinin__InfluenzaA__ABD61359

SEQ ID NO: 31262 - RNA, 1701 nt, Artificial Sequence; identical to SEQ ID NO: 31214
  hemagglutinin__InfluenzaA__ABD61370

SEQ ID NO: 31263 - RNA, 1701 nt, Artificial Sequence; identical to SEQ ID NO: 31154
  hemagglutinin__InfluenzaA__ABD61381

SEQ ID NO: 31264 - RNA, 1701 nt, Artificial Sequence
  hemagglutinin__InfluenzaA__ABD61392
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggggaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31265 - RNA, 1701 nt, Artificial Sequence
  hemagglutinin__InfluenzaA__ABD61403
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccccauugugauggcuuccaaaauaaggaaugggaccuuuuuguugaacgcagcacagccuacagcaacuguuacccuuaugaugugccggauuaugccucccuuaggucacuaguugccucauccggcacacuugaguuuaacaaugaaagcuucaauuggacuggagucgaucagaauggaacaagcucugcuugcaaaaggagaucuacuaaaaguuucuuuaguagauugaauugguugcaccaauuaaaauacaaauauccagcacugaacgugacuaugccaaacaaugaaaaauuugacaaauuguacauuugggggguucaccauccgaguacggacagugaccaaaucagccuauaugcucaagcaucagggagagucacagucucuaccaaaagaagccaacaaacuguaaccccgaauaucggaucuagacccuggguaaggggugucuccagcagaauaagcauuuauuggacaauaguaaaaccgggagacauacuuuugauuaacagcacagggaaucuaauugcuccucgggguuacuucaaaauacgaagugggaaaagcucaauaaugaggucaaaugcacucauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaaacaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31266 - RNA, 1701 nt, Artificial Sequence
  hemagglutinin__InfluenzaA__ABD61529
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaaagcaaauauccagugcugaacgugacuaugccaaacaauggcaaauuugacaaauuguacauuugggggguucaccacccgagcacggacaaagaacaaaccaaccuauauguucgagcaucagggagagucacagucucuaccaagagaagccagcaaacuguaaucccgaauaucgggucuagacccuggguaaggggucugucuagcagaauaaguaucuauuggacaauaguaaaaccgggagacauacuguuaauuaauagcacugggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggagacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 31267 - RNA, 1698 nt, Artificial Sequence; identical to SEQ ID NO: 31245
  hemagglutinin__InfluenzaA__ABD61540

SEQ ID NO: 31268 - RNA, 1701 nt, Artificial Sequence
  hemagglutinin__InfluenzaA__ABD61757
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31269 - RNA, 1701 nt, Artificial Sequence
  hemagglutinin__InfluenzaA__ABD61777
augaagacuaucauugcuuugagcuacauuuucugucuggguuucgcccaaaaacuucccggaaaugacaacagcacagcaacgcugugccugggacaccaugcagugccaaacggaacgcuagugaaaacaaucacgaaugaucagauugaagugacuaaugcuacugagcugguucagaguuccucaacagguagaauaugcgacaguccucaccgaauccuugaugggaaaaacugcacacugauagaugcucuauugggagacccucauugugauggcuuccaaaaugagaaaugggaccuuuuuguugaacgcagcaaagcuuucagcaacuguuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguacgaaucagaaagcaaauauccagcgcugaacgugacuaugccaaacaauggcaaauuugacaaauuguacauuugggggguucaccacccgagcacggacaaagaacaaaccaaccuauauguucgagcaucagggagagucacagucucuaccaagagaagccagcaaacuguaaucccgaauaucgggucuagacccuggguaaggggucugucuaguagaauaagcaucuauuggacaauaguaaaaccgggagacauacuguugauuaauagcacuggaaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagguauguuaaacaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugcuugcauaggaucaaucagaaauggaacuuaugaccaugauguauacagagacgaagcauugaacaaccgguuucagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 31270 - RNA, 1701 nt, Artificial Sequence
  hemagglutinin__InfluenzaA__ABD77598
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccccaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcagguuucauagaaaaugguugggaaggaaugguggacgguugguacgguuucaggcaucaaaauucugagggcacaggacaagcagcagaucuuaaaagcacucaagcugcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31271 - RNA, 1701 nt, Artificial Sequence
  hemagglutinin__InfluenzaA__ABD77609
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugaguugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31272 - RNA, 1701 nt, Artificial Sequence
  hemagglutinin__InfluenzaA__ABD77620
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagagguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugaguugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31273 - RNA, 1701 nt, Artificial Sequence; identical to SEQ ID NO: 31271
  hemagglutinin__InfluenzaA__ABD77631

SEQ ID NO: 31274 - RNA, 1701 nt, Artificial Sequence; identical to SEQ ID NO: 31271
  hemagglutinin__InfluenzaA__ABD77642

SEQ ID NO: 31275 - RNA, 1701 nt, Artificial Sequence; identical to SEQ ID NO: 31271
  hemagglutinin__InfluenzaA__ABD77653

SEQ ID NO: 31276 - RNA, 1698 nt, Artificial Sequence; identical to SEQ ID NO: 31245
  hemagglutinin__InfluenzaA__ABD77708

SEQ ID NO: 31277 - RNA, 1698 nt, Artificial Sequence
  hemagglutinin__InfluenzaA__ABD77719
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagaaaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31278 - RNA, 1698 nt, Artificial Sequence
  hemagglutinin__InfluenzaA__ABD77730
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuugggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaaaggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31279 - RNA, 1701 nt, Artificial Sequence; identical to SEQ ID NO: 31271
  hemagglutinin__InfluenzaA__ABD77752

SEQ ID NO: 31280 - RNA, 1701 nt, Artificial Sequence; identical to SEQ ID NO: 31271
  hemagglutinin__InfluenzaA__ABD77763

SEQ ID NO: 31281 - RNA, 1701 nt, Artificial Sequence
  hemagglutinin__InfluenzaA__ABD77774
augaagacuaucauugcuuugagcuacauuuuaugucugguuuucgcucaaaaacuuccuguaaaugacaacagcacggcaacgcugugccugggacaccaugcagugccaaacggaacgcuagugaaaacaaucacgaaugacaacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaacgaaagcuucaauuggacuggagucgaucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggaaaaugcaauucugaaugcaucacucaaaauggaagcauucccaaugacaaaccauuucaaaauguaaacaggaucacauauggggccugucccagauauguuaaacaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaaggaagaauccaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuaa

SEQ ID NO: 31282 - RNA, 1701 nt, Artificial Sequence
  hemagglutinin__InfluenzaA__ABD77785
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugacaacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaacgaaagcuucaauuggacuggagucgaucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggaaaaugcaauucugaaugcaucacucaaaauggaagcauucccaaugacaaaccauuucaaaauguaaacaggaucacauauggggccugucccagauauguuaaacaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaaggaagaauccaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuaa

SEQ ID NO: 31283 - RNA, 1701 nt, Artificial Sequence
  hemagglutinin__InfluenzaA__ABD77807
augaaagcaaaacuacugauccuguuaugugcacuuucagcuacagaugcagacacaauauguauaggcuaccaugcgaacaacucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuuaggaaacccagaaugcgaaucacugcuuucuaagagaucaugguccuacauugcagaaacaccaaacucugagaauggaacauguuacccaggagauuucgccgacuaugaggaacugagggagcaauugagcucagugucaucauucgagagauucgaaauauuccccaaggaaagaucauggcccaaacacaacauaaccagaggaguaacggcagcaugcucccaugcggggaaaagcaguuuuuacaaaaauuugcucuggcugacggagacaaauggcucauacccaaagcugagcaaguccuaugugaacaauaaagagaaagaaguccuugugcuaugggguguucaucacccgucuaacauagaggaucaaaagacccucuaucggaaagaaaaugcuuaugucucuguagugucuucaaauuauaacaggagauucaccccggaaauagcagaaagacccaaaguaagaggucaagcagggagaaugaacuauuacuggacuuugcuagaacccggagacacaauaauauuugaggcaaauggaaaucuaauagcgccaugguaugcuuucgcacugaguagaggcuuuggaucaggaaucaucaccucaaacgcaucaauggaugaaugugacacgaagugucaaacaccccagggagcuauaaacaguagucucccuuuucagaauauacacccagucacaauaggagagugcccaaaauacgucaagaguaccaaauugaggaugguuacaggauuaaggaacaucccauccauucaauccagaggucuguuuggagccauugccgguuucauugaggggggauggacuggaaugauagauggaugguaugguuaccaucaucagaaugaacagggaucuggcuaugcugcggaucaaaaaagcacacaaaaugcaauuaacgggauuacaaauaaggugaacucuguuaucgagaaaaugaacacucaauucacagcuguggguaaagaauucaacaaauuagaaaaaagaauggaaaacuuaaauaaaaaaguugaugauggauuucuggacauuuggacauauaaugcagaauuguugguucuacuggaaaaugaaaggacuuuggauuuccaugacucaaaugugaagaaucuguaugagaaaguaaaaaaccaauuaaggaauaaugcaaaggaaauaggaaacggguguuuugaguucuaccacaaguguaacaaugaaugcauggaaaguguaaaaaauggaacuuaugauuacccaaaauauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguucuaaugggucuuugcaaugcagaauaugcaucuga

SEQ ID NO: 31284 - RNA, 1701 nt, Artificial Sequence
  hemagglutinin__InfluenzaA__ABD77818
augaaagcaaaacugcugguccuguuaugugcacuuucagcuacagaugcagacacaauauguauaggcuaccaugcgaacaacucaaccgauacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugugaaucacuguuuucuaagaaaucaugguccuacauugcagaaacaccaaacuccgagaaugggacauguuacccaggguauuucgccgacuaugaggaacugagggagcaauugaguucaguaucaucauucgagagauucgaaauauuccccaaggaaaguucauggcccaaacacaccguaaccagaggaguaacggcuucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucaaacauagaggaccaaaagaccaucuaucguaaagaaaaugcuuaugucucuguagugucuucacauuauaacagaagauucaccccagaaauagcaaaacgacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaauacgucaggaguacaaaauuaaggauggucacaggacuaaggaacauuccauccauucaauccagagguuuguuuggagccauugcugguuucauugaagggggauggacuggaaugauagauggaugguaugguuaucaucaucagaaugaacagggauccggcuaugcugcagaucaaaaaagcacacaaaaugccauuaacgggauuacaaacaaggugaacucuguuaucgagaaaaugaacacucaauucacagcuguagguaaagaauucaacaaauuagaaaaaaggauggaaaacuuaaauaaaaaaguugaugauggguuucuggacauuuggacauauaaugcagaauuguugguucuacuggaaaaugaaaggacuuuggauuuucaugacucaaaugugaagaaccuguaugagaagguaaaaagccaauuaaagaguaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31285 - RNA, 1701 nt, Artificial Sequence
  hemagglutinin__InfluenzaA__ABD77829
augaagacuaucauugcuuugagcuacauuuuauaucugguuuucgcucaaaaacuucccggaaaugacaacagcacggcaacgcugugccugggacaccaugcagugccaaacggaacacuagugaaaacaaucacgaaugaccaaauugaagugacuaaugcuacugagcugguucagaguuccucaacagguagacuaugcgacaguccucaccgaauccuugacgggaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucagaauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggggucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaaugggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagguucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31286 - RNA, 1701 nt, Artificial Sequence
  hemagglutinin__InfluenzaA__ABD77862
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagcauauauguucaagcaucagggagagucacagucucuaccaaaagaagccaacaaacuguaaucccgaauaucgggucuagacccuggguaaggggggucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaauggaagcauucccaaugacaaaccuuuucagaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaaugggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31287 - RNA, 1701 nt, Artificial Sequence
  hemagglutinin__InfluenzaA__ABD77884
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcuuguucaggguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcauauauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccuagagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31288 - RNA, 1701 nt, Artificial Sequence
  hemagglutinin__InfluenzaA__ABD77895
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaagggguaucuccagcagaauaagcauauauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucagcgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31289 - RNA, 1701 nt, Artificial Sequence
  hemagglutinin__InfluenzaA__ABD77906
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcuuguucaggguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcauauauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaucacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31290 - RNA, 1698 nt, Artificial Sequence
  hemagglutinin__InfluenzaA__ABD77917
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauagggaaccaaaaggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31291 - RNA, 1698 nt, Artificial Sequence
  hemagglutinin__InfluenzaA__ABD77928
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaaaaaguccuuguacuaugggguguucaucacccgccuaacauaggggaccaaaaggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31292 - RNA, 1698 nt, Artificial Sequence
  hemagglutinin__InfluenzaA__ABD77939
augaaaguaaaacuacugguccuguuauguacauuuacagcuacauaugcagacacaauauguauaggguaccaugccaacaacucaaccgacacuguugacacagugcuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31293 - RNA, 1698 nt, Artificial Sequence; identical to SEQ ID NO: 31246
  hemagglutinin__InfluenzaA__ABD77950

SEQ ID NO: 31294 - RNA, 1698 nt, Artificial Sequence
  hemagglutinin__InfluenzaA__ABD77961
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgcccaacauaggggaccaaaaggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31295 - RNA, 1698 nt, Artificial Sequence
  hemagglutinin__InfluenzaA__ABD77983
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaaccuggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31296 - RNA, 1698 nt, Artificial Sequence; identical to SEQ ID NO: 31246
  hemagglutinin__InfluenzaA__ABD77994

SEQ ID NO: 31297 - RNA, 1698 nt, Artificial Sequence; identical to SEQ ID NO: 31245
  hemagglutinin__InfluenzaA__ABD78005

SEQ ID NO: 31298 - RNA, 1698 nt, Artificial Sequence; identical to SEQ ID NO: 31245
  hemagglutinin__InfluenzaA__ABD78016

SEQ ID NO: 31299 - RNA, 1698 nt, Artificial Sequence; identical to SEQ ID NO: 31246
  hemagglutinin__InfluenzaA__ABD78027

SEQ ID NO: 31300 - RNA, 1698 nt, Artificial Sequence
  hemagglutinin__InfluenzaA__ABD78038
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucaucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggagagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31301 - RNA, 1701 nt, Artificial Sequence; identical to SEQ ID NO: 31282
  hemagglutinin__InfluenzaA__ABD78049

SEQ ID NO: 31302 - RNA, 1698 nt, Artificial Sequence
  hemagglutinin__InfluenzaA__ABD78060
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggaguauaucagauucuggcgaucuacucaacugucgccaguucccugguucuuuuggucucccugggggcaaucagcuucuggauguguuccaaugggucuuugcaguguagaauaugcaucuga

SEQ ID NO: 31303 - RNA, 1698 nt, Artificial Sequence
  hemagglutinin__InfluenzaA__ABD78071
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguggaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31304 - RNA, 1698 nt, Artificial Sequence
  hemagglutinin__InfluenzaA__ABD78093
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31305 - RNA, 1701 nt, Artificial Sequence
  hemagglutinin__InfluenzaA__ABD78115
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggggucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaauggaagcauucccaaugacaaaccuuuucagaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaaugggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagaaacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31306 - RNA, 1701 nt, Artificial Sequence
  hemagglutinin__InfluenzaA__ABD78126
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggggucuccagcauaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaauggaagcauucccaaugacaaaccuuuucagaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaaugggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31307 - RNA, 1701 nt, Artificial Sequence
  hemagglutinin__InfluenzaA__ABD79032
augaagacuaucauugcuuugagcuacauuuucugucugguucucggccaagacuuuccaggaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucagugaaggcuucacuuggacuggggucacucagaaugggggaagcaaugcuugcaaaaggggaccugauaucgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuauuuuaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcaugucccaaguauguuaagcaaaacacccugaaguuggcaacagggaugcggaauguaccagagaaacaaacuagaggccuauucagcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31308 - RNA, 1701 nt, Artificial Sequence
  hemagglutinin__InfluenzaA__ABD79112
augaaagcaaaacuacugauccuguuaugugcacuuucagccacagaugcagacacaauauguauaggcuaccaugcgaacaacucaaccgacacuguugauacaguacucgaaaagaaugugacagugacacacucuguaaaccuacucgaagacagccacaacgggaaauuaugcagauuaaaaggaauagccccacuacaauuggggaaauguaacauugccggauggaucuuaggaaacccagaaugcgaaucacugcuuucuaagagaucaugguccuacauugcagaaacaccaaacucugagaauggagcauguuauccaggagauuucgccgacuaugaggaacugagggagcaauugagcucaguaucaucauucgagagauucgaaauauuccccaagggaagaucauggcccgaacacaacauagacauaggaguaacagcagcaugcucccaugcggggaaaagcaguuuuuacaaaaauuugcucuggcuaacggagaaagauggcucauacccaaaucugaacaaguccuaugugaacaagaaagagaaagaaguccuuauacuaugggguguucaucacccgccuaacauagagaaucaaaagacccucuaucggaaagaaaaugcuuaugucucuguagugucuucaaauuauaacaggagauucaccccggaaauagcagaaagacccaaaguaagaggucaagcagggagaauaaacuauuacuggacuuugcuagaacccggagacacaauaauauuugaggcaaauggaaaucuaauagcgccaugguaugcuuucgcacuaaauagaggcauugggucaggaaucaucaccucaaacgcaucaauggaugaaugugacacaaagugucaaacaccccagggagcuauaaacaguagucucccuuuccagaauauacacccauucacaauaggagagugcccaaaauacgucaggaguaccaaauugaggaugguuacaggacuaaggaacaucccauccauucaauccagaggucuguuuggagccauugccgguuucauugaagggggaugggauggaaugauagauggaugguaugguuaccaucaucagaaugaacagggaucuggcuaugcugcggaucaaaaaagcacacaaaaugccauuaacgggauuacaaauaagguaaacucuguuaucgagaaaaugaacacucaauucacugcuguggguaaagaauucaacaaauuagaaaaaagaauggaaaacuuaaauaaaaaaguugaugauggauuucuggacauuuggacauauaaugcagaauuguugguucuacuggaaaacgaaaggacuuuggauuuccaugacucaaaugugaagaaucuguaugagaaaguaaaaaaccaauuaaggaauaaugccaaagaaauaggaaacggguguuuugaguucuaccacaaguguaacaaugaaugcauggaaaguguaaaaaauggaacuuaugauuacccaaaauuuucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguucuaaugggucuuugcagugcagaauaugcaucuga

SEQ ID NO: 31309 - RNA, 1701 nt, Artificial Sequence
  hemagglutinin__InfluenzaA__ABD79123
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauuuccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucagaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 31310 - RNA, 1701 nt, Artificial Sequence
  hemagglutinin__InfluenzaA__ABD79134
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuuccaaaauaagaaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauuuccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaacagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 31311 - RNA, 1701 nt, Artificial Sequence
  hemagglutinin__InfluenzaA__ABD79145
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggaccggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauuuccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 31312 - RNA, 1701 nt, Artificial Sequence
  hemagglutinin__InfluenzaA__ABD79156
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauuuccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 31313 - RNA, 1701 nt, Artificial Sequence
  hemagglutinin__InfluenzaA__ABD79167
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaauuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuagaugcaacauuugcauuuga

SEQ ID NO: 31314 - RNA, 1701 nt, Artificial Sequence; identical to SEQ ID NO: 31312
  hemagglutinin__InfluenzaA__ABD79178

SEQ ID NO: 31315 - RNA, 1701 nt, Artificial Sequence
  hemagglutinin__InfluenzaA__ABD79189
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaguaguaaaaccgggagacauacuuuugauuaacagcacagggaaucuaauugcuccucgggguuacuucaaaauacgaagugggaaaagcucaauaaugaggucggaugcacccauugacagcugcaauucugaaugcauuacuccaaauggaagcauuuccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 31316 - RNA, 1701 nt, Artificial Sequence; identical to SEQ ID NO: 31312
  hemagglutinin__InfluenzaA__ABD79200

SEQ ID NO: 31317 - RNA, 1701 nt, Artificial Sequence
  hemagglutinin__InfluenzaA__ABD79211
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuuccaaaauaaggaaugggaccuuuuuguugaacgcagcacagcuuacagcaacuguuacccuuaugaugugccggauuaugccucccuuaggucacuaguugccucauccggcacccuggaguuuaccaaagaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggauaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcauuacuccaaauggaagcauuuccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 31318 - RNA, 1701 nt, Artificial Sequence; identical to SEQ ID NO: 31313
  hemagglutinin__InfluenzaA__ABD79222

SEQ ID NO: 31319 - RNA, 1701 nt, Artificial Sequence; identical to SEQ ID NO: 31313
  hemagglutinin__InfluenzaA__ABD79233

SEQ ID NO: 31320 - RNA, 1701 nt, Artificial Sequence
  hemagglutinin__InfluenzaA__ABD79244
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggaaaaaacugcacacugauagaugcucuauugggagacccucauugugauggcuucaaaaauaaggaaugggaccuuuuuguugaacgcagcacagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucggaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugaaggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauguauacagagacgaagcauuaaacaauagguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31321 - RNA, 1701 nt, Artificial Sequence; identical to SEQ ID NO: 30822
  hemagglutinin__InfluenzaA__ABD94734

SEQ ID NO: 31322 - RNA, 1701 nt, Artificial Sequence; identical to SEQ ID NO: 31139
  hemagglutinin__InfluenzaA__ABD94745

SEQ ID NO: 31323 - RNA, 1701 nt, Artificial Sequence
  hemagglutinin__InfluenzaA__ABD94767
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugacaacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaacgaaagcuucaauuggacuggagucgaucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaaauguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggaaaaugcaauucugaaugcaucacuccaaauggaagcauucccaaugacaaaccauuucaaaauguaaacaggaucacauauggggccugucccagauauguuaaacaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaaggaagaauccaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuaa

SEQ ID NO: 31324 - RNA, 1698 nt, Artificial Sequence
  hemagglutinin__InfluenzaA__ABD94778
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugaugggguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31325 - RNA, 1698 nt, Artificial Sequence; identical to SEQ ID NO: 31304
  hemagglutinin__InfluenzaA__ABD94789

SEQ ID NO: 31326 - RNA, 1701 nt, Artificial Sequence
  hemagglutinin__InfluenzaA__ABD94822
augaagacuaucauugcuuugagcuacauuuuaugucugguuuucgcucaaaaaauucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggagaaaacugcacacugauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggaguucuauuaaaaguuucuuuaguagauugaauugguugcaccaauuaaaauacaaauauccagcacugaacgugacuaugccaaacaaugacaaauuugacaaauuguacauuugggggguucaccacccgaguacggacagugaccaaaccagccuauaugcucaagcaucagggagagucacagucucuaccaaaagaagccaacaaacuguaaucccaaauaucggaucuagacccuggguaaggggugucuccagcagaauaagcaucuauuggacaauaguaaaaccgggagacauacuuuugauuaauagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacuaagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31327 - RNA, 1701 nt, Artificial Sequence
  hemagglutinin__InfluenzaA__ABD94833
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcgacuguuacccuuaugaugugccggauuaugcuucccuuaggucacuaguugccucauccggcacccuagaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuuuauguucaagcaucagggagagucacagucucuaccaaaagaagccaacaaacuguaaucccgaauaucgggucuagacccuggguaaggggggucuccagcagaauaagcaucuauuggacaauaguaaaaccgggagacauacuuuugauuaauagcacagggaaucuaauugccccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaaugggaaacugaauagguuaaucgagaaaacgaacgagaaauuccaucaaaucgaaaaagaauucucagaaguagaagggagaauucaggaccucgaaaaauauguugaagacacuaaaauagaucucuggucuuacaacgcagagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31328 - RNA, 1701 nt, Artificial Sequence
  hemagglutinin__InfluenzaA__ABD94844
augaagacuaucauugcuuugagcuacauuuuauguaugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuucaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccuguauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31329 - RNA, 1701 nt, Artificial Sequence
  hemagglutinin__InfluenzaA__ABD94855
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucaggguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaacaaugaaagcuucaauuggacuggagucgcccagaauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcauauauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 31330 - RNA, 1701 nt, Artificial Sequence
  hemagglutinin__InfluenzaA__ABD94866
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacgguccucaccaaauccuugauggaaaaaacugcacacugauagaugcucuauuaggagacccucauugugauggcuuccaaaauaaggaaugggaccuuuuuguugaacgcagcaaagcuuacagcaacuguuacccuuaugaugugccggauuaugccucccuuaggucacuaguugccucuuccggcacccuggaguuuaccaaugaaagcuucaauuggacuggagucgcucagaauggaacaagcuaugcuugcaaaaggggaucuguuaaaaguuucuuuaguagauugaauugguugcacaaauuagaauacaaauauccagcacuaaacgugacuaugccaaacaaugacaaauuugacaaauuguacauuugggggguucaccacccgaguacggacagugaccaaaccagccuauauguucaaucaucagggagaaucacagucucuaccaaaagaagccaacaaacuguaaccccgaauaucgggucuagacccuggguaaggggugucuccagcagaauaagcaucuauuggacaauaguaaaaccgggagacauacuuuugauuaccagcacagggaaucuaauugcuccucgggguuacuucaaaauacgaagggggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuucaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugcaugcauagggucaaucagaaauggaacuuaugaccaugauguauacagagacgaagcauuaaacaaccgguuccagaucaaagguguugagcugaaaucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31331 - RNA, 1701 nt, Artificial Sequence
  hemagglutinin__InfluenzaA__ABD94877
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcaggauaagcauauauuggacaauaguaaaaccgggagacauacuuuugauuaacagcacagggaaucuaauugcuccucgggguuacuucaaaauacgaaguggaaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31332 - RNA, 1701 nt, Artificial Sequence
  hemagglutinin__InfluenzaA__ABD94888
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuucaaaaauaaggaaugggaccuuuuuguugaacgcagcacagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucuaaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaagaaagcaacugagggaaaaugcugaggacaugggcaaugguugcuucaaaauauaucacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31333 - RNA, 1701 nt, Artificial Sequence; identical to SEQ ID NO: 31312
  hemagglutinin__InfluenzaA__ABD94899

SEQ ID NO: 31334 - RNA, 1701 nt, Artificial Sequence
  hemagglutinin__InfluenzaA__ABD94910
augaagacuaucauugcuuugagcuacauucuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaauuccucaacagguaggauaugugacaguccucaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcggaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucagaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31335 - RNA, 1701 nt, Artificial Sequence
  hemagglutinin__InfluenzaA__ABD94921
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacgguccucaccaaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaagcuucaauuggacuggagucgcucagaauggaacaagcuaugcuugcaaaaggggaucuguuaaaaguuucuuuaguagauugaauugguugcacaaauuagaauacaaauauccagcacuaaacgugacuaugccaaacaaugacaaauuugacaaauuguacauuugggggguucaccacccgaguacggacagugaccaaaccagccuauauguucaaucaucagggagagucacagucucuaccaaaagaagccaacaaacuguaaccccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagggggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuucaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugcaugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31336 - RNA, 1701 nt, Artificial Sequence; identical to SEQ ID NO: 31312
  hemagglutinin__InfluenzaA__ABD94932

SEQ ID NO: 31337 - RNA, 1698 nt, Artificial Sequence
  hemagglutinin__InfluenzaA__ABD94943
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaaaagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 31338 - RNA, 1701 nt, Artificial Sequence; identical to SEQ ID NO: 31137
  hemagglutinin__InfluenzaA__ABD94954

SEQ ID NO: 31339 - RNA, 1698 nt, Artificial Sequence
  hemagglutinin__InfluenzaA__ABD94965
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucaucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggagagaaggauggaaaacuuaaauaaaaagguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31340 - RNA, 1698 nt, Artificial Sequence; identical to SEQ ID NO: 31245
  hemagglutinin__InfluenzaA__ABD94987

SEQ ID NO: 31341 - RNA, 1698 nt, Artificial Sequence; identical to SEQ ID NO: 31245
  hemagglutinin__InfluenzaA__ABD94998

SEQ ID NO: 31342 - RNA, 1698 nt, Artificial Sequence
  hemagglutinin__InfluenzaA__ABD95009
augaaaguaaaacuacugguccuguuauguacauuuacagcuacauaugcagacacaauauguauaggguaccaugccaacaacucaaccgacacuguugacacaguacuugagaagaaugugacagugacacacucagucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaaaggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31343 - RNA, 1698 nt, Artificial Sequence; identical to SEQ ID NO: 31246
  hemagglutinin__InfluenzaA__ABD95020

SEQ ID NO: 31344 - RNA, 1698 nt, Artificial Sequence
  hemagglutinin__InfluenzaA__ABD95031
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucaccgacuaugaggaacugagggagcaauugaguucaguaucuucauuugagagauucgaaauauuccccaaagaaagcucauggcccaaccacaccguaaccggaguaucagcaucaugcucccauaaugggaaaaguaguuuuuacagaaauuugcuauggcugacggggaagaaugguuuguacccaaaccugagaagguccuaugcaaacaacaaagagaaagaaguccuuguacuaugggguguucaucacccgccuaacauaggggaccaaaaggcccucuaucauacagaaaaugcuuaugucucuguagugucuucacauuauagcagaagauucaccccagaaauagccaaaagacccaaaguaagaggucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuauaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31345 - RNA, 1698 nt, Artificial Sequence
  hemagglutinin__InfluenzaA__ABD95042
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauuugaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagggaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31346 - RNA, 1698 nt, Artificial Sequence
  hemagglutinin__InfluenzaA__ABD95053
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagggaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31347 - RNA, 1698 nt, Artificial Sequence; identical to SEQ ID NO: 31304
  hemagglutinin__InfluenzaA__ABD95064

SEQ ID NO: 31348 - RNA, 1698 nt, Artificial Sequence
  hemagglutinin__InfluenzaA__ABD95075
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguaaaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31349 - RNA, 1698 nt, Artificial Sequence; identical to SEQ ID NO: 31346
  hemagglutinin__InfluenzaA__ABD95086

SEQ ID NO: 31350 - RNA, 1698 nt, Artificial Sequence; identical to SEQ ID NO: 31304
  hemagglutinin__InfluenzaA__ABD95097

SEQ ID NO: 31351 - RNA, 1698 nt, Artificial Sequence
  hemagglutinin__InfluenzaA__ABD95119
augaaagcaaaacuacugauccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugaugggguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31352 - RNA, 1698 nt, Artificial Sequence
  hemagglutinin__InfluenzaA__ABD95130
augaaagcaaaacuacugguccuguuauguacauuuacagcuacauacgcagacacaauauguauaggcuaccaugccaacaacucaaccgacacuguugacacaguacuugagaagaacgugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguucguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacccaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31353 - RNA, 1698 nt, Artificial Sequence; identical to SEQ ID NO: 31304
  hemagglutinin__InfluenzaA__ABD95141

SEQ ID NO: 31354 - RNA, 1698 nt, Artificial Sequence; identical to SEQ ID NO: 31304
  hemagglutinin__InfluenzaA__ABD95152

SEQ ID NO: 31355 - RNA, 1698 nt, Artificial Sequence; identical to SEQ ID NO: 31351
  hemagglutinin__InfluenzaA__ABD95163

SEQ ID NO: 31356 - RNA, 1698 nt, Artificial Sequence; identical to SEQ ID NO: 31346
  hemagglutinin__InfluenzaA__ABD95174

SEQ ID NO: 31357 - RNA, 1698 nt, Artificial Sequence
  hemagglutinin__InfluenzaA__ABD95185
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaauggggaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacccaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31358 - RNA, 1698 nt, Artificial Sequence
  hemagglutinin__InfluenzaA__ABD95196
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauucccuaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagggaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31359 - RNA, 1698 nt, Artificial Sequence
  hemagglutinin__InfluenzaA__ABD95207
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31360 - RNA, 1698 nt, Artificial Sequence; identical to SEQ ID NO: 31304
  hemagglutinin__InfluenzaA__ABD95218

SEQ ID NO: 31361 - RNA, 1698 nt, Artificial Sequence
  hemagglutinin__InfluenzaA__ABD95229
augaaagcaaaacuacugauccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaagagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugaugggguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31362 - RNA, 1698 nt, Artificial Sequence
  hemagglutinin__InfluenzaA__ABD95240
augaaagcaaaacugcugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31363 - RNA, 1698 nt, Artificial Sequence
  hemagglutinin__InfluenzaA__ABD95251
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagggaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauugaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31364 - RNA, 1698 nt, Artificial Sequence
  hemagglutinin__InfluenzaA__ABD95262
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucagcaucaugcucccacaaugggaaaagcaguuuuuacagaaaucugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaacgggaucacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31365 - RNA, 1698 nt, Artificial Sequence; identical to SEQ ID NO: 31304
  hemagglutinin__InfluenzaA__ABD95273

SEQ ID NO: 31366 - RNA, 1698 nt, Artificial Sequence; identical to SEQ ID NO: 31302
  hemagglutinin__InfluenzaA__ABD95284

SEQ ID NO: 31367 - RNA, 1698 nt, Artificial Sequence
  hemagglutinin__InfluenzaA__ABD95295
augaaagcaaaacugcugguccuguuauguacauuuacagcuacauacgcagacacaauaugcauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31368 - RNA, 1698 nt, Artificial Sequence
  hemagglutinin__InfluenzaA__ABD95306
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaauccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugaugggguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31369 - RNA, 1698 nt, Artificial Sequence; identical to SEQ ID NO: 31346
  hemagglutinin__InfluenzaA__ABD95328

SEQ ID NO: 31370 - RNA, 1701 nt, Artificial Sequence
  hemagglutinin__InfluenzaA__ABD95339
augaaagcaaaacugcugguccuguuaugugcacuuucagcuacagaugcagacacaauauguauaggcuaccaugcgaacaacucaaccgauacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugugaaucacuguuuucuaagaaaucaugguccuacauugcagaaacaccaaacucugagaaugggacauguuacccaggguauuucgccgacuaugaggaacugagggagcaauugaguucaguaucaucauucgagagauucgaaauauuccccaaggaaaguucauggcccaaacacagcguaaccagaggaguaacggcaucaugcucccauaaggggaaaagcaguuuuuacagaaauuugcuauggcugacggagaaaaauggcucguacccaaaucugagcaaguccuaugugaacgacaaagagaaagaaguccuuguacuaugggguguucaucacccgucuaacauagaggaccaaaagaccaucuaucguaaagaaaaugcuuaugucucuguagugucuucacauuauaacagaagauucaccccagaaauagcaaaacgacccaaaguaagagaucaagaagggagaauuaacuacuacuggacucugcuggaaccaggggacacaauaauauuugaggcaaauggaaaucuaauagcgccaugguaugcuuucgcacugaguagaggcuuugggucaggaaucaucaccucaaacguaucaauggaugaaugugacgcgaagugucaaacaccccagggagcuauaaacaguagucuuccuuuccagaauguacacccagucacaauaggagagugcccaaaauacgucaggaguacaaaauuaaggauggucacaggacuaaggaacauuccauccauucaauccagagguuuguuuggagccauugccgguuucauugaagggggauggacuggaaugauagauggaugguaugguuaucaucaucagaaugaacagggauccggcuaugcugcagaucaaaaaagcacacaaaaugccauuaacgggauuacaaacaaggugaacucuguuaucgagaaaaugaacacucaauucacagcuguagguaaagaauucaacaaauuagaaaaaaggauggaaaacuuaaauaaaaaaguugaugauggguuucuggacauuuggacauauaaugcagaauuguugguucuacuggaaaaugaaaggacuuuggauuuucaugacucaaaugugaagaaccuguaugagaagguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31371 - RNA, 1698 nt, Artificial Sequence; identical to SEQ ID NO: 31300
  hemagglutinin__InfluenzaA__ABE11657

SEQ ID NO: 31372 - RNA, 1698 nt, Artificial Sequence
  hemagglutinin__InfluenzaA__ABE11668
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaagggauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucaaggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauucugaagaaucaaaguuaaacagggagaaaauugauggaguaaaauuggaaucgaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31373 - RNA, 1698 nt, Artificial Sequence
  hemagglutinin__InfluenzaA__ABE11679
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacggggaggaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuga

SEQ ID NO: 31374 - RNA, 1698 nt, Artificial Sequence
  hemagglutinin__InfluenzaA__ABE11690
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31375 - RNA, 1698 nt, Artificial Sequence
  hemagglutinin__InfluenzaA__ABE11701
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaaaggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauccaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuauaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31376 - RNA, 1698 nt, Artificial Sequence; identical to SEQ ID NO: 31304
  hemagglutinin__InfluenzaA__ABE11712

SEQ ID NO: 31377 - RNA, 1698 nt, Artificial Sequence; identical to SEQ ID NO: 31358
  hemagglutinin__InfluenzaA__ABE11723

SEQ ID NO: 31378 - RNA, 1698 nt, Artificial Sequence
  hemagglutinin__InfluenzaA__ABE11734
augaaagcaaaacuacugauccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcuaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugaugggguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31379 - RNA, 1698 nt, Artificial Sequence
  hemagglutinin__InfluenzaA__ABE11812
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggacgaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31380 - RNA, 1698 nt, Artificial Sequence
  hemagglutinin__InfluenzaA__ABE11823
augaaagcaaaacuacugguucuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagggaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31381 - RNA, 1698 nt, Artificial Sequence; identical to SEQ ID NO: 31346
  hemagglutinin__InfluenzaA__ABE11834

SEQ ID NO: 31382 - RNA, 1698 nt, Artificial Sequence; identical to SEQ ID NO: 31358
  hemagglutinin__InfluenzaA__ABE11845

SEQ ID NO: 31383 - RNA, 1698 nt, Artificial Sequence; identical to SEQ ID NO: 31351
  hemagglutinin__InfluenzaA__ABE11856

SEQ ID NO: 31384 - RNA, 1701 nt, Artificial Sequence
  hemagglutinin__InfluenzaA__ABE11900
augaaagcaaaacuacuaguccuguugugugcauuuacagcuacauaugcagacacgauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaaugggacauguuacccaggguauuucgccgacuaugaggaacugagggagcaauugagcucaguaucaucauucgagagauucgaaauauuccccaaggaaagcucauggcccaaccacaccguaaccaaaggaguaacggcaucaugcucccauaaugggaaaagcaguuuuuacaaaaauuugcuauggcugacggagaagaauggcuuguacccaaaucugagcaaguccuauguaaacaacaaggagaaagaaguccuuguacuaugggguguucaucacccgucuaacauaggggaccaaagggccaucuaccauacagaaaaugcuuaugucucuguagugucuucacauuauagcagaagauucaccccagaaauagcaaaaagacccaaaguaagagaccaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaaggaggguggacuggaaugauagauggaugguaugguuaucaucaucagaaugaacaaggaucuggcuaugcugcggaccaaaaaagcacacaaaaugccauuaaugggauuacaaacaaggugaauucuguaaucgagaaaaugaacacucaauucacagcuguaggcaaagaauucaacaaauuagaaagaaggauggaaaacuuaaauaagaaaguugaugauggauuucuggacauuuggacauauaaugcagaauuguugguucuccuggaaaaugaaaggacuuuggauuuucaugacucaaaugugaagaaucuguaugagaaaguaaaaacccaauugaagaauaaugccaaagaaauagggaacggguguuuugaauucuaucacaaguguaacaaugaaugcauggaaagugugaaaaaugggacuuaugacuauccaaaauacuccgaagaaucaaaguuaaacagggaaaaaauugauggagugaaauuggaaucaaugggagucuaucagauucuggcgaucuacucaacugucgccaguucacuggugcuuuugaucucccugggggcaaucaguuucuggauguguucuaaugggucuuugcaguguagaauaugcaucuga

SEQ ID NO: 31385 - RNA, 1701 nt, Artificial Sequence
  hemagglutinin__InfluenzaA__ABE11942
augaaagcaaaacuacuaguccuguugugugcauuuacagcuacauacgcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaauccugagaauggaacauguuacccaggguauuucgccgacuaugaggaacugagggagcaauugagcucaguaucaucauucgagagauucgaaauauuccccaaggaaagcucauggcccaaccacaccguaaccaaaggaguaacggcaucaugcucccauaaugggaaaagcaguuuuuacaaaaauuugcuauggcugacggagaagaauggcuuguacccaagucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagagaccaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaaggaggguggacuggaaugauagauggaugguaugguuaucaucaucagaaugaacaaggaucuggcuaugcugcggaccaaaaaagcacacaaaaugccauuaaugggauuacaaacaaggugaauucuguaaucgagaaaaugaacacucaauucacagcuguaggcaaagaauucaacaaauuagaaagaaggauggaaaacuuaaauaagaaaguugaugauggauuucuggacauuuggacauauaaugcagaauuguugguucuccuggaaaaugaaaggacuuuggauuuucaugacucaaaugugaagaaucuguaugagaaaguaaaaacccaauugaagaauaaugccaaagaaauagggaacggguguuuugaauucuaucacaaguguaacaaugaaugcauggaaagugugaaaaaugggacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31386 - RNA, 1701 nt, Artificial Sequence
  hemagglutinin__InfluenzaA__ABE12078
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaaaaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcagcauuugcauuuga

SEQ ID NO: 31387 - RNA, 1701 nt, Artificial Sequence; identical to SEQ ID NO: 31282
  hemagglutinin__InfluenzaA__ABE12123

SEQ ID NO: 31388 - RNA, 1698 nt, Artificial Sequence; identical to SEQ ID NO: 31304
  hemagglutinin__InfluenzaA__ABE12248

SEQ ID NO: 31389 - RNA, 1701 nt, Artificial Sequence
  hemagglutinin__InfluenzaA__ABE12623
augaagacuaucauugcuuugagcuacauuuucugucugguucucggccaagaucuuccaggaaaugacaacagcacagcaacgcugugccugggacaucaugcggugccaaacggaacacuagugaaaacaaucacaaaugaucagauugaagugacuaaugcuacugagcugguucagagcuccucaacggggaaaauaugcaacaauccucaucgaauccuugauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucaggcacucuggaguuuaucaaugaggguuucacuuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacgaaccaagaacaaaccagccuauauguucaagcaucagggagagucacagucucuaccaagagaagccagcaaacuauaaucccgaauaucgggucuagacccuggguaaggggucugucuaguagaauaagcaucuauuggacaauaguuaaaccgggagacauacugguaauuaauaguaaugggaaccuaauugcuccucgggguuauuucaaaaugcgcacugggaaaagcucaauaaugaggucagaugcaccuauugguaccuguauuucugaaugcaucacuccaaauggaagcauucccaaugacaaacccuuucaaaacguaaacaagaucacauauggggcaugucccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaagcuguuugaaaaaacaaggaggcaacugagggaaaaugcugaggacaugggcaaugguugcuucagaauauaccacaaaugugacaaugcuugcauagggucaaucagaaaugggacuuaugaccaugauguauacagagacgaagcauuaaacaaccgguuucagaucaaagguguugaacugaaaucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 31390 - RNA, 1701 nt, Artificial Sequence; identical to SEQ ID NO: 31334
  hemagglutinin__InfluenzaA__ABE12645

SEQ ID NO: 31391 - RNA, 1701 nt, Artificial Sequence; identical to SEQ ID NO: 31312
  hemagglutinin__InfluenzaA__ABE13076

SEQ ID NO: 31392 - RNA, 1701 nt, Artificial Sequence
  hemagglutinin__InfluenzaA__ABE13323
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcuuguucaggguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcauauauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31393 - RNA, 1701 nt, Artificial Sequence
  hemagglutinin__InfluenzaA__ABE13471
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaauuccucaacagguaggauaugugacaguccucaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuuacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcggaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucagaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31394 - RNA, 1701 nt, Artificial Sequence
  hemagglutinin__InfluenzaA__ABE13555
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucaggguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacaucugggggguucaccacccgaguacggacagugaccaaaccagccuauauguucaagcaucagggagagucacagucucuaccaaaagaagccaacaaacuguaaucccgaacaucggaucuagacccuggguaaggggugucuccagcagaauaagcauauauuggacaauaguaaaaccgggagacauacuuuugauuagcagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuaaaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccaugucauguuuuuugcuuuguguuguuuuguugggguucaucaugugggccugccaaaaaggcaacauuaggugcaacauuugcauuuga

SEQ ID NO: 31395 - RNA, 1701 nt, Artificial Sequence
  hemagglutinin__InfluenzaA__ABE13606
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagaugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuauugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31396 - RNA, 1701 nt, Artificial Sequence
  hemagglutinin__InfluenzaA__ABE13628
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaacuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguggaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31397 - RNA, 1701 nt, Artificial Sequence
  hemagglutinin__InfluenzaA__ABE13824
augaagacuaucauugcuuugagcuacauuuuaugucagguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugauaaauuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggaggauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucgggauacaaagauuggauccuauggauuucuuuugccauaucaugcuuuuugcuuuguguuguuuugcugggguucaucaugugggccugccaaaaaggcaacauuaggugcaacauuugcauuuga

SEQ ID NO: 31398 - RNA, 1701 nt, Artificial Sequence
  hemagglutinin__InfluenzaA__ABE14019
augaagacuaucauugcuuugagcuacauuuuaugucagguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugauaaauuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucgggauacaaagauuggauccuauggauuucuuuugccauaucaugcuuuuugcuuuguguuguuuugcugggguucaucaugugggccugccaaaaaggcaacauuaggugcaacauuugcauuuga

SEQ ID NO: 31399 - RNA, 1701 nt, Artificial Sequence
  hemagglutinin__InfluenzaA__ABE14030
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaauagguagaauaugcgacaguccucaccgaauccuugauggaaaaaacugcacacugauagaugcucuguugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaacuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaaugggaaacugaauagguuaaucgagaaaacgaacgagaaauuccaucaaaucgaaaaagaauucucagaaguggaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuucugcuuuguguuguuuugcugggguucaucaugugggccugccaaaaaggcaacauuaggugcaacauuugcauuuga

SEQ ID NO: 31400 - RNA, 1701 nt, Artificial Sequence; identical to SEQ ID NO: 31396
  hemagglutinin__InfluenzaA__ABE14041

SEQ ID NO: 31401 - RNA, 1701 nt, Artificial Sequence; identical to SEQ ID NO: 31398
  hemagglutinin__InfluenzaA__ABE14063

SEQ ID NO: 31402 - RNA, 1701 nt, Artificial Sequence
  hemagglutinin__InfluenzaA__ABE14124
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuugaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaaggggugucuccagcagaauaagcaucuauuggacaauuguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauuuucagaaguagaagggagaauucaggaccucgagaaauauguugaagacacuaaaauagaucucuggucuuacaacgcggagcuucuuauugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31403 - RNA, 1701 nt, Artificial Sequence
  hemagglutinin__InfluenzaA__ABE14464
augaagacuaucauugcuuugagcuacauuuuaugucagguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacuaauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggauagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugauagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucgggauacaaagauuggauccuauggauuucuuuugccauaucaugcuuuuugcuuuguguuguuuugcugggguucaucaugugggccugccaaaaaggcaacauuaggugcaacauuugcauuuga

SEQ ID NO: 31404 - RNA, 1701 nt, Artificial Sequence
  hemagglutinin__InfluenzaA__ABE14840
augaagacuaucauugcuuugagcuacauuuuaugucugguuuucgcucaaaaacuucccagaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaacuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuagcagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguggaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggauaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcagcauuugcauuuga

SEQ ID NO: 31405 - RNA, 1701 nt, Artificial Sequence
  hemagglutinin__InfluenzaA__ABE15578
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaacuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguggaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcagcauuugcauuuga

SEQ ID NO: 31406 - RNA, 1701 nt, Artificial Sequence
  hemagglutinin__InfluenzaA__ABE26991
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugacugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaacguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31407 - RNA, 1701 nt, Artificial Sequence
  hemagglutinin__InfluenzaA__ABF47550
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucacucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaccuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcagcucugaaugcaucacuccaaauggaagcauucccaaugacaaacccuuucaaaauguaaacaagaucacauauggggcaugucccagguauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaggcauuaaacaaccgguuccagaucaaagguguugagcugaagucaggauacaaagacuggaucuuauggauuuccuuugccauaucaugcuuuuugcuuuguguuguuuugcugggguucaucaugugggccugccaaaaaggcaacauuaggugcaacauuugcauuuga

SEQ ID NO: 31408 - RNA, 1698 nt, Artificial Sequence
  hemagglutinin__InfluenzaA__ABF47561
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaacugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31409 - RNA, 1698 nt, Artificial Sequence
  hemagglutinin__InfluenzaA__ABF47572
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagauaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31410 - RNA, 1698 nt, Artificial Sequence
  hemagglutinin__InfluenzaA__ABF47583
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccguccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31411 - RNA, 1701 nt, Artificial Sequence
  hemagglutinin__InfluenzaA__ABF47594
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacauugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacagaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31412 - RNA, 1701 nt, Artificial Sequence
  hemagglutinin__InfluenzaA__ABF47605
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaguggaaauuuaauagcgccaugguacgcuuucgcauugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauagaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31413 - RNA, 1701 nt, Artificial Sequence; identical to SEQ ID NO: 31398
  hemagglutinin__InfluenzaA__ABF47616

SEQ ID NO: 31414 - RNA, 1701 nt, Artificial Sequence
  hemagglutinin__InfluenzaA__ABF47627
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugacugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31415 - RNA, 1701 nt, Artificial Sequence
  hemagglutinin__InfluenzaA__ABF47638
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucacauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauaacaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaccaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggguuucuggacauuuggacauauaaugcagaguuguugguucuccuggaaaaugaaaggacuuuggauuuucaugacucaaaugugaagaaucuguaugagaaaguaaaaacccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31416 - RNA, 1701 nt, Artificial Sequence
  hemagglutinin__InfluenzaA__ABF47649
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucacauaaugggaaaaguaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauaacaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaccaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggguuucuggacauuuggacauauaaugcagaguuguugguucuccuggaaaaugaaaggacuuuggauuuucaugacucaaaugugaagaaucuguaugagaaaguaaaaacccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31417 - RNA, 1701 nt, Artificial Sequence
  hemagglutinin__InfluenzaA__ABF47660
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguauucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugacugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaacccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31418 - RNA, 1698 nt, Artificial Sequence
  hemagglutinin__InfluenzaA__ABF47671
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuuugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31419 - RNA, 1701 nt, Artificial Sequence
  hemagglutinin__InfluenzaA__ABF47693
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcaacauugccggauggaucuuaggaaacccagaaugcgaaucacuguuuucuaagaaaucaugguccuacauugcagaaacaccaaacuccgagaauggaacauguuacccaggauauuucgccgacuaugaggaauugagggagcaauugagcucaguaucaucauucgagagauucgaaauauuccccaaggaaagaucauggcccaaacacaacguaaccagaggcguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcagaaagacccaaaguaagaggucaagcagggagaauuaacuacuacuggacucugcuggaacccggggacacaauaauauuugaggcaaauggaaaucuaauagcgccauggcaugcuuucgcacugaauagaggcuuugggucaggaaucaucaccucaaacgcaucgauggaugaaugugacacgaagugucaaacaccccagggagcuauaaacaguagucuuccuuuccagaauauacacccagucacaauaggggagugcccaaaauacgucaggaguacaaaauugaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuagugcuuuuggucucccugggggcaaucagcuucuggauguguucuaaugggucuuugcagugcagaauaugcaucuga

SEQ ID NO: 31420 - RNA, 1701 nt, Artificial Sequence
  hemagglutinin__InfluenzaA__ABF47704
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcaacauugccggauggaucuuaggaaacccagaaugcgaaucacuguuuucuaagaaaucaugguccuacauugcagaaacaccaaacuccgagaauggaacauguuacccaggauauuucgccgacuaugaggaauugagggagcaauugagcucaguaucaucauucgagagauucgaaauauuccccaaggaaagaucauggcccaaacacaacguaaccagaggcguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcagaaagacccaaaguaagaggucaagcagggagaauuaacuacuacuggacucugcuggaacccggggacacaauaauauuugaggcaaauggaaaucuaauagcgccauggcaugcuuucgcacugaauagaggcuuugggucaggaaucaucaccucaaacgcaucgauggaugaaugugacacgaagugucaaacaccccagggagcuauaaacaguagucuuccuuuccagaauauacacccagucacaauaggggagugcccaaaauacgucaggaguacaaaauugaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31421 - RNA, 1701 nt, Artificial Sequence
  hemagglutinin__InfluenzaA__ABF47715
augaaagcaaaacuacugguccuguuaugugcacuuucagcuacagaugcagacacaauauguauaggcuaccaugcgaacaacucaacugacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuuccaagaaaucaugguccuacauugcagaaacaccaaacuccgagaauggaacauguuacccaggauauuucgccgacuaugaggaauugagggagcaauugagcucaguaucaucauucgagagauucgaaauauuccccaaggaaagaucauggcccaaacacaacguaaccagaggcguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacagaagauucaccccagaaauagcagaaagacccaaaguaagaggucaagcagggagaauuaacuacuacuggacucugcuggaaccuggggacacaauaauauuugaggcaaauggaaaucuaauagcgccauggcaugcuuucgcacugaauagaggcuuugggucaggaaucaucaccucaaacgcaucgauggaugaaugugacacgaagugucaaacaccccagggagcuauaaacaguagucuuccuuuccagaauauacacccagucacaauaggagagugcccaaaauacgucaggaguacaaaauugaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31422 - RNA, 1701 nt, Artificial Sequence; identical to SEQ ID NO: 31420
  hemagglutinin__InfluenzaA__ABF47726

SEQ ID NO: 31423 - RNA, 1701 nt, Artificial Sequence
  hemagglutinin__InfluenzaA__ABF47737
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcaacauugccggauggaucuuaggaaacccagaaugcgaaucacuguuuucuaagaaaucaugguccuacauugcagaaacaccaaacuccgagaauggaacauguuacccaggauauuucgccgacuaugaggaauugagggagcaauugagcucaguaucaucauucgagagauucgaaauauuccccaaggaaagaucauggcccaaacacaacguaaccagaggcguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcagaaagacccaaaguaagaggucaagcagggagaauuaacuacuacuggacucugcuggaacccggggacacaauaauauuugaggcaaauggaaaucuaauagcgccauggcaugcuuucgcacugaauagaggcuuugggucaggaaucaucaccucaaacgcaucgauggaugaaugugacacgaagugucaaacaccccagggagcuauaaacaguagucuuccuuuccagaauauacacccagucacaauaggggagugcccaaaauacgucaggaguacaaaauugaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaauuuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31424 - RNA, 1701 nt, Artificial Sequence
  hemagglutinin__InfluenzaA__ABF47748
augaaagcaaaacugcugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaggaaaguucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacgcgaagugucaaacaccccagggagcuauaaacaguagucuuccuuuccagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguaaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31425 - RNA, 1701 nt, Artificial Sequence
  hemagglutinin__InfluenzaA__ABF47770
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31426 - RNA, 1701 nt, Artificial Sequence; identical to SEQ ID NO: 31425
  hemagglutinin__InfluenzaA__ABF47781

SEQ ID NO: 31427 - RNA, 1701 nt, Artificial Sequence; identical to SEQ ID NO: 31425
  hemagglutinin__InfluenzaA__ABF47792

SEQ ID NO: 31428 - RNA, 1701 nt, Artificial Sequence; identical to SEQ ID NO: 31425
  hemagglutinin__InfluenzaA__ABF47803

SEQ ID NO: 31429 - RNA, 1701 nt, Artificial Sequence; identical to SEQ ID NO: 31425
  hemagglutinin__InfluenzaA__ABF47814

SEQ ID NO: 31430 - RNA, 1701 nt, Artificial Sequence; identical to SEQ ID NO: 31425
  hemagglutinin__InfluenzaA__ABF47825

SEQ ID NO: 31431 - RNA, 1701 nt, Artificial Sequence; identical to SEQ ID NO: 31425
  hemagglutinin__InfluenzaA__ABF47836

SEQ ID NO: 31432 - RNA, 1701 nt, Artificial Sequence; identical to SEQ ID NO: 31425
  hemagglutinin__InfluenzaA__ABF47847

SEQ ID NO: 31433 - RNA, 1701 nt, Artificial Sequence
  hemagglutinin__InfluenzaA__ABF47858
augaagacuaucauugcuuugagcuacauuuuaugucugguuuucgcucaaaaacuucccggaaaugacaacggcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcauaaauuagaauacaaauauccagcgcugaacgugaccaugccaaacaauggaaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31434 - RNA, 1698 nt, Artificial Sequence; identical to SEQ ID NO: 31246
  hemagglutinin__InfluenzaA__ABF47869

SEQ ID NO: 31435 - RNA, 1698 nt, Artificial Sequence
  hemagglutinin__InfluenzaA__ABF47880
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagguucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31436 - RNA, 1698 nt, Artificial Sequence
  hemagglutinin__InfluenzaA__ABF47891
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacgaggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcaaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31437 - RNA, 1701 nt, Artificial Sequence
  hemagglutinin__InfluenzaA__ABF47902
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaucgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31438 - RNA, 1698 nt, Artificial Sequence
  hemagglutinin__InfluenzaA__ABF47955
augaaggcaaaacuacugguccuguuauaugcauuuguagcuacagaugcagacacaauauguauaggcuaccaugcgaacaacucaaccgacacuguugacacaauauucgagaagaauguggcagugacacauucuguuaaccugcucgaagacagacacaacgggaaacuauguaaauuaaaaggaauagccccacuacaauuggggaaauguaacaucaccggauggcucuugggaaauccagaaugcgacucacugcuuccagcgagaucaugguccuacauuguagaaacaccaaacucugagaauggagcauguuauccaggagauuucaucgacuaugaggaacugagggagcaauugagcucaguaucaucauuagaaagauucgaaauauuucccaaggaaaguucauggcccaaccacacauucaacggaguaacaguaucaugcucccauaggggaaaaagcaguuuuuacagaaauuugcuauggcugacgaagaagggggauucauacccaaagcugaccaauuccuaugugaacaauaaagggaaagaaguccuuguacuaugggguguucaucacccgucuagcagugaugagcaacagagucucuauaguaauggaaaugcuuaugucucuguagcgucuucaaauuauaacaggagauucaccccggaaauagcugcaaggcccaaaguaaaagaucaacaugggaggaugaacuauuacuggaccuugcuagaacccggagacacaauaauauuugaggcaacugguaaucuaauagcaccaugguaugcuuucgcacugaguagaggguuugaguccggcaucaucaccucaaacgcgucaaugcaugaguguaacacgaagugucaaacaccccagggaucuauaaacagcaaucucccuuuccagaauauacacccagucacaauaggagagugcccaaaauaugucaggaguaccaaauugaggaugguuacaggacuaagaaacaucccauccauucaauacagaggucuauuuggagccauugcugguuuuauugaggggggauggacuggaaugauagauggaugguaugguuaucaucaucagaaugaacagggaucaggcuaugcagcggaucaaaaaagcacacagaaugccauuaacaggauuacaaacaaggugaacucuguuaucgagaaaaugaacacucaauucacagcuguggguaaagaauucaacaacuuagaaaaaaggauggaaaauuuaaauaaaaaaguugaugauggguuucuggacauuuggacauauaaugcagaauuguuaguucuacuggaaaaugaaagaacuuuggauuuccaugacuuaaaugugaagaaucuguacgagaaaguaaaaagccaauuaaagaauaaugccaaagaaaucggaaauggguguuuugaguucuaccacaagugugacaaugaaugcauggaaaguguaagaaaugggacuuaugauuauccaaaauauucagaagaaucaaaguugaacagggaaaagauagauggagugaaauuggaaucaauggggguguaucagauucuggcgaucuacucaacugucgccaguucacuggugcuuuuggucucccugggggcaaucaguuucuggauguguucuaaugggucuuugcagugcagaauaugcaucuga

SEQ ID NO: 31439 - RNA, 1698 nt, Artificial Sequence
  hemagglutinin__InfluenzaA__ABF60576
augaagacaaccauuauuuugauacuacugacccaugcuguggacagucaaaacccaaucaguggcaacaacacagccacacuaugucugggacaccaugcaguagcaaauggaacauugguaaaaacaauaacugaugaccaaauugaggugacaaaugcuacugaauuaguucagagcacuucaauagggaaaauaugcaacaacccauauaggguucuagauggaagaaacugcacauuaauagaugcaaugcuaggagauccccacugugauguuuuucaguaugagaauugggaccucuucauagaaagaagcagcgcuuucagcaauugcuacccauaugacaucccugacuaugcaucgcuccggucuauuguggcaucuucaggaacauuagaauucacagcagagggauucacauggacaggugucacucaaaacggaggaaguggcgccugcagaaggggaucagccgauaguuucuuuagccgacugaauuggcuaacaaaaucuggaaauucuuaccccacauugaaugugacaaugccuaacaaugacaauuucgauaaacuauacaucugggggauccaucacccgagcacaaacaaugagcagacaaaauuguauguccaagaauuagggcgaguaacagucucaacaaaaagaagucaacaaacaauaauccccaacaucggaucuagaccgggggucaggggucaagcaggcaggauaagcauauauuggaccauugugaaaccuggagauauccuaaugauaaacaguaauggcaacuuaguugcaccgcggggauauuucaaaaugcgaacaggaaaaagcucuauaaugagaucagaugcacccauagacacuuguugguccgaguguauuacaccaaauggaagcauccccaacgacaaaccauuucaaaaugugaacaaaguuacauauggaaaaugccccaaguauaucaagcagaauacuuugaagcuggccacugggaugaggaauguaccagaaaagcaaaucagaggaaucuuuggagcaauagcgggauucauagaaaauggcugggagggaaugguugaugggugguauggauuccgauaucagaauucggaaggaacaggacaagcugcagaucuaaagagcacucaagcagccaucgaccagaucaauggaaaauugaacagagugauugagaggaccaaugagaaauuccaucaaauagagaaggaauucucagaaguagaagggagaauccaggacuuggagaaguauguagaagacaccaaaauagaccuaugguccuacaaugcagaguuacugguggcucuagaaaaucaacauacgauugacuuaacagaugcagagaugaauaaauuauucgagaagacuaggcgccaguuaagagaaaacgcggaagacaugggggguggauguuucaagauuuaucacaaaugugauaaugcaugcauuggaucaauaagaaaugggacauaugaccauuacauauacagagaugaagcauuaaacaaccgauuucaaauuaaagguguugaguugaaaucaggcuacaaagauuggauacuguggauuucauucgccauaucaugcuucuuaauuugcguuguucuauuggguuucaucaugugggcuugcgaaaaaggcaacaucagaugcaacauuugcauuuga

SEQ ID NO: 31440 - RNA, 1701 nt, Artificial Sequence
  hemagglutinin__InfluenzaA__ABF60577
augaagaccaucauuguucuaagcuacuuuuucugucuggcucucagccaagacuacucagaaagcaacaacagcacugcaacacugugcuuggggcaucaugcggugccaaaugggacaauagugaagacaauuacggaugaccaaauugaggugaccaaugccacugagcugguccagagcuccucaacagggaaaauaugcaacaacccucaucgaauccuugauggaagggacuguacacugauagaugcccuacugggagacccucacugugauguauuccaagaugaaaccugggaccuuuauguggaacguagcagcgccuucagcaacugcuacccauaugauguaccagacuaugcaucacugaggucucuaguugcuuccucaggaacccuagaguucaucacagaaggauucacauggacaggagucacucaaaauggaggaagcaaugccugcaaaagagggccugcuagugguuucuucagcagacugaauuggcugacuaaaucuggaaguacuuacccaguguugaaugugaccaugccaaaugaugacaacuuugacaaauuguaugucuggggaguucaccacccgagcacaaaccaagagcaaaccgaccuauacguucaggcaucaggaagggucacaguuucaacuagaaggagucaacaaaccauaaucccgaauauuggauccaggccuugggucaggggccaaucaggaaggauaagcaucuacuggacaauagugaagccgggggauguacuaguaauuaacaguaaugguaaccugaucgcuccuagaggguacuucaaaauacgcacugggaaaagcucaauaaugagaucagaugcaccuauugacacaugcaucucugaauguaucacuccuaauggaagcauccccaaugacaagccauuucagaauguaaacaagaucacuuacggagcauguccuaaguaugucaaacagagcacuuugaaacuggcaacagggaugaggaacgugccugagaaaaagaccaggggucuguucguggcaauagcaggauuuauagaaaauggaugggaaggaaugauagacugcugguacgguuucagacaccagaacucugaggguacaggacaagcugcagaucuaaaaagcacacaggcagccauugaccagauuaaugggaaguugaaccgaguaaucgagaagacaaaugagaaguuucaccagauugaaaaggaauucucugaaguagaaggaagaauccaggaccuugagaacuauguugaggacacuaagauagaucuauggucuuacaaugcagagcuucugguggccuuggaaaaucagcauacaauugaucugacugauucugaaaugaacaaacuguucgaaagaacaaggcggcaacugagggagaaugcugaagacaugggcaguggcugcuucaaaauauaccacaaaugugacaacgcauguauagagucaaucaggaacgggaccuaugaucaugacauauacagagaugaagcauuaaacaaccgauuucaaaucaaggguguagagcuaaaaucuggguacaaagauuggaucuuauggauuuccuuugccacaucaugcuuuuugcuuuguguuguucuggggggguucauuaugugggccugccaaagaggcaacauuaggugcaacauuugcauuuga

SEQ ID NO: 31441 - RNA, 1701 nt, Artificial Sequence
  hemagglutinin__InfluenzaA__ABF60578
augaagaccauuauuguucuaagcuguuuuuucugucuggcuuucagccaagaucuuucagagaacaacaacaacacugcaacacugugccuggggcaucaugcaguaccaaaugggacaauagugaaaacaauaacggaugaucaaauugaagugacuaaugcuacugaacugguucagaguuccucaacagggaaaauaugcaacaauccucacagaauucucgauggaagagacugcacacuaauagaugcccuacuaggggacccucauugugauguauuccaagaugaaacaugggaccuuuauguagagcgcagcaaauccuucagcaacugcuacccauaugaugugccagacuaugcaucucucagaucucuaguggccucaucaggaacccuagaguucaucaccgaagccuucacguggacaggagucacacaaaauggagggaguggugcuugcaaaagaggacccgguaaugguuucuucaguagacugaauuggcugacuaaaucugguagcgcuuauccagugcugaacgugacuaugccaaacaacgauaacuuugacaaguuguacguguggggaguucaucacccaagcacaaaccaagagcaaaccaaucuguacguucaggcaucgggaagggucacaguuucaacuagaagaagccagcaaaccauaauuccuaacaucggauccaggccuugggucagaggccaaucuaggagaauaaguaucuacuggacaauaguuaagccgggagauauacuggugaucaacagcaauggaaaucuaauugcuccucgagguuacuuuaagaugcgcacugggaaaagcucaauaaugagaucagaugcaccuauugacacauguaucucugagugcaucacuccaaacgggagcaucccuaaugacaagcccuuucagaauguaaacaaaauuacuuauggagcaugucccaaauauaucaaacaaagcacccuaaaguuggcaacagggaugcggaauguaccugagaaacaaaccaggggucuguuuggugcaauagcaggguucauagaaaauggaugggaaggaaugauagaugguugguaugguuucaggcaucagaacucggaaggcacaggacaagcagcagaccuuaaaagcacucaagccgccauugaucagaucaaugggaaauugaaccgaguaaucgagaaaacaaaugaaaaguuucaucagauugaaaaggaauuuucugaaguggaagggagaauucaggaccuugagaaauaugucgaagacacuaaaauagaucuauggucuuacaaugcggacguucuuguggcccuggaaaaccagcauacaauugaucugacugauucagaaaugaacaaacuauuugaaaagacaaggagacagcugagggagaaugcugaagacaugggcaauggcugcuucaagauauaccacaaaugugacaacgcuuguauagagucaaucaggaaugggacuuaugaucaugacauauacagagaugaagcacuaaacaaucgauuucagaucaaaggguguggagugaaaucuggauacaaagauuggaucuuauggauuuccuuugccauaucaugcuuuuugcuguguguuguucuacugggauucaucaugugggccugccagagaggcaacauuaggugcaacauuugcauuuga

SEQ ID NO: 31442 - RNA, 1701 nt, Artificial Sequence
  hemagglutinin__InfluenzaA__ABF60579
augaagacucucauugcuuugagcuacauuuucugucugguucuuggccaagaccuuccaggaaauggcaacagcacagcaacacugugccugggacaucaugcggugccaaacggaacgcuagugaaaacaaucacggaugaucagaucgaagugacuaaugcuacugagcugguccagaauuucucaauggauaaaauaugcaacaauccucaucgaauucuugauggagcaaacugcacacugauagaugcucuauugggggacccucauugugaugacuuucaaaaugagaaaugggaccuuuucguugaacgcagcaaggcuuucagcaacuguuacccuuaugaugugccagauuauaccucccuuaggucacuaauugccucgucaggcacuuuggaguuuaucaaugaagauuucaauuggacuggggucacucagaauggaggaagcaaugcuugcaagagggggccugauagcaguuuuuucaguaggcugaacugguuguacaaaucagguaacacauauccgaugcuaaacgugacuaugccaaacagugauaauuuugacaaauuauacauuugggggguucaucacccgagcacagccagggaacaaaccaaccuauauguucaagcaucagggaaaguaacaguuuccaccaagagaagccagcagaccauaaucccgaauaucgggucuagacccuggguaaggggucugucuaguagaauaagcaucuauuggacaauaguuaaaccgggggacauccugguaauuaauaguaaugggaaccuaauugcuccucgggguuacuucaaaaugcacacugggagaagcucaauaaugaggucagaugcaccuauugacaccugcaguucugaaugcauaacuccaaauggaagcauucccaaugacaagcccuuucaaaacguaaacaagaucacauauggggcauguccuaaguauguuaagcaaaacacucugaaguuggcaacagggaugcggaauauaccagaaaaacaaacuagaggcauauucggugcaauagcagguuucauagagaaugguugggaagggaugguagacggcugguacgguuucagacaucaaaauucugagggcacaggacaagcagcagaucuuaaaagcacccaagcagcuaucgaccaaaucaaugggaaacugaauaggguaaucgagaaaacgaacgagaaauuccaucaaaucgaaaaggaauucucaggaguagaagggagaauucaggaccucgagaaauacguugaagacacuaaaauagaucucuggucuuacaaugcggaacuucuugucgcucuggagaaccaacauacaaucgauuugacugacucggaaaugaacaaacuguuugaaaaaacaaggaggcaacugagggaaaaugcugaagacaugggaaaugguugcuucaaaauauaccacaaaugugacaaugcuugcauagagucaaucagaaauggaacuuaugaccauaacgaauacagagacgaagcauuaaacaaccgguuucagaucaaagguguugagcugaagucaggauacaaagacuggauccuguggauuuccuuugccauaucaugcuuuuugcuuuguguuguucugcugggauucaucaugugggccugccagaaaggcaacauuaggugcaacauuugcaucuga

SEQ ID NO: 31443 - RNA, 1701 nt, Artificial Sequence
  hemagglutinin__InfluenzaA__ABF60580
augaagacuaucauugcuuugagcuacauuuucugucuggcuuucgcccaagaccuuccaggaaaugacaacagcacagcaacucuuugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaauccagcaaacuguaaucccgaaugucgggucuagacccuggguaaggggucuaucuaguagaguaagcaucuauuggacaauaguuaaaccgggagacguacugguaauuaauaguaauggaaaccuaauugcuccucgggguuacuacaaaaugcgcacugggaaaagcucaauaaugaggucagaugcaccuauuggcacuugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagguucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 31444 - RNA, 1701 nt, Artificial Sequence
  hemagglutinin__InfluenzaA__ABF60581
augaagaccaucauuguucuaagcuacuuuuucugucuggcucucagccaagacuacucagaaagcaacaacagcacugcaacacugugcuuggggcaucaugcgguaccaaaugggacaauagugaagacaauuacugaugaccaaauugaagugaccaaugccacugagcugguccagagcuccucaacagggaaaauaugcaacaacccucauagaauccuugauggaagggacuguacacugauagaugcccuacugggggacccccacugugauguauuccaagaugaaaccugggaccuuuauguggaacguagcagcgccuucagcaacugcuacccauaugauguaccagacuaugacucacucaggucucuaguugcuuccucaggaacccuagaguucaucacagaaggauucacauggacaggagucacucaaaauggaggaagcaaugcuugcaaaagagggccugcuagugguuucuucagcagacugaauuggcugacuaaaucuggaaguacuuacccaguguugaaugugacuaugccaaauaaugacaacuuugacaaacuguaugucuggggaguucaccacccgagcacaaaccaagagcaaaccaaccuauacguucaggcaucagggagggucacaguuucaacuagaaggagucaacaaaccauaaucccgaauauuggauccaggccuugggucaggggccaaucaggacggauaagcaucuauuggacaauagugaagccgggagauguacuaguaauuaacaguaaugguaaccugaucgcuccucgaggauacuucaagaugcgcacuggaaaaagcucaauaaugagaucagaugcgccuauugacacaugcaucucugaauguauuacuccuaauggaagcauccccaaugacaugcccuuucagaauguaaacaagaucacuuacggagcauguccuaaguaugucaaacagggcacuuugaaauuggcaacaggaaugaggaacgugccugagaaacagacuaggggucuguucggugcaauagcaggauuuauagaaaauggaugggaaggaaugauagacgguugguaugguuucagacaccagaacucugaggguacaggacaagcagcagaccuaaaaagcacucaggcagccaucgaccagauuaaugggaaguugaaccgaguaaucgagaagacaaaugagaaguuucaccagauugaaaaggaauucucugaaguagaaggaagaauccaggaccuugagaaauauguugaggacacuaagauagaucuauggucugacaaugcagagcuucuugucgccuuggaaaaccagcauacaauugaucugacugauucugaaaugaacaaacuauucgaaaaaacaaggaggcaacugagggaaaaugcugaagugaugggcaacgguugcuucaaaauauaccacaaaugugacaacgcauguauagagucaaucaggaacgggacuuaugaucaugacauauacagagaugaagcauuaaacaaccgauuucaaaucaaggguguagagcuaaaaucuggguacaaagacuggaucuuauggauuuccuuugccauaucaugcuuuuugcuuuguguuguucuacugggguucauuaugugggccugccaaagaggcaacauuaggugcaacauuugcauuuga

SEQ ID NO: 31445 - RNA, 1701 nt, Artificial Sequence; identical to SEQ ID NO: 31244
  hemagglutinin__InfluenzaA__ABF82651

SEQ ID NO: 31446 - RNA, 1698 nt, Artificial Sequence; identical to SEQ ID NO: 31304
  hemagglutinin__InfluenzaA__ABF82662

SEQ ID NO: 31447 - RNA, 1698 nt, Artificial Sequence
  hemagglutinin__InfluenzaA__ABF82673
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaagggaucaugguccuacauuguagaaacaccaaaucccgagaauggaacauguuacccaggguauuucgcagacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31448 - RNA, 1698 nt, Artificial Sequence
  hemagglutinin__InfluenzaA__ABF82684
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauucccuaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagggaaagaaguccuugugcuaugggguguucaucacccaccuaacauaggggaccaaagggcccucuaccauacagaaaaugcuuaugucucuguagugucuucacauuauaguagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31449 - RNA, 1701 nt, Artificial Sequence; identical to SEQ ID NO: 31312
  hemagglutinin__InfluenzaA__ABF82695

SEQ ID NO: 31450 - RNA, 1701 nt, Artificial Sequence; identical to SEQ ID NO: 31287
  hemagglutinin__InfluenzaA__ABF82706

SEQ ID NO: 31451 - RNA, 1698 nt, Artificial Sequence; identical to SEQ ID NO: 31359
  hemagglutinin__InfluenzaA__ABF82819

SEQ ID NO: 31452 - RNA, 1698 nt, Artificial Sequence; identical to SEQ ID NO: 31304
  hemagglutinin__InfluenzaA__ABF82830

SEQ ID NO: 31453 - RNA, 1698 nt, Artificial Sequence; identical to SEQ ID NO: 31304
  hemagglutinin__InfluenzaA__ABF82841

SEQ ID NO: 31454 - RNA, 1698 nt, Artificial Sequence; identical to SEQ ID NO: 31304
  hemagglutinin__InfluenzaA__ABF82852

SEQ ID NO: 31455 - RNA, 1698 nt, Artificial Sequence
  hemagglutinin__InfluenzaA__ABF82863
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguucuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31456 - RNA, 1698 nt, Artificial Sequence
  hemagglutinin__InfluenzaA__ABF82874
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaauuaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31457 - RNA, 1698 nt, Artificial Sequence
  hemagglutinin__InfluenzaA__ABF82885
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacaggaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31458 - RNA, 1698 nt, Artificial Sequence
  hemagglutinin__InfluenzaA__ABF82896
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucagggaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31459 - RNA, 1698 nt, Artificial Sequence
  hemagglutinin__InfluenzaA__ABF82907
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucuccguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31460 - RNA, 1698 nt, Artificial Sequence; identical to SEQ ID NO: 31348
  hemagglutinin__InfluenzaA__ABF82929

SEQ ID NO: 31461 - RNA, 1698 nt, Artificial Sequence
  hemagglutinin__InfluenzaA__ABF82940
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaccuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31462 - RNA, 1701 nt, Artificial Sequence
  hemagglutinin__InfluenzaA__ABF83447
augaagaccaucauugcuuugagcuacauuuucugucuggcucucggccaagaccuuccaggaaaugacaacaacacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggggagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 31463 - RNA, 1644 nt, Artificial Sequence
  hemagglutinin__InfluenzaA__ABG20468
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaaacucugcgaucuagauggagugaagccucuaauuuuaagagauuguaguguagcuggggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggggugagcucagcauguccauaccagggaagguccuccuuuuuuagaaaugugguauggcuuaucaaaaagaacaaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagauugguaccaaaaauagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaauuggaauaugguaacugcaacaccaagugugaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 31464 - RNA, 1707 nt, Artificial Sequence
  hemagglutinin__InfluenzaA__ABG20472
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagauauacuggaaaaggcacacaacgggaagcucugcgaucuagacggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaagaguucuuggucagaucaugaagccucaucaggggugagcucagcauguccauaccagggaagguccuccuuuuuuagaaaugugguauggcuuaucaaaaaggacaaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagauugguaccaaaaauagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguugcaaugcagaauuugcauuuaa

SEQ ID NO: 31465 - RNA, 1707 nt, Artificial Sequence
  hemagglutinin__InfluenzaA__ABG20478
auggagaaaauagugcuucuuuuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaagcucugcgaucuagauggagugaagccucuaauuuuaagagauuguaguguagcuggauggcuccucgggaacccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuuggucagaucaugaagccucaucaggggugagcucagcauguccauaccagggaagguccuccuuuuuuagaaaugugguauggcuuaucaaaaaggacaaugcauacccaacaauaaagagaaguuacaauaauaccaaccaagaagaucuuuugguacugugggggauucaccauccaaaugaugcagcagagcagacaaggcucuaucaaaacccaaccaccuauauuuccguugggacaucaacacuaaaccagagauugguaccaaaaauagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaagaaaaaagagaggacuauuuggagcuauagcagguuuuauagaaggaggauggcagggaaugguagaugguugguauggguaccaucauagcaacgagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggaacuugguaacgguuguuucgaguucuaucacagaugugauaaugaauguauggaaaguguaagaaacgguacguaugacuacccgcaguauucagaagaagcaagauuaaaaagagaggaaauaaguggaguaaaauuggaaucaauaggaaccuaccaaauacugucaauuuauucaacaguggcgagcucccuagcacuggcaaucaugguggcuggucuaucuuuauggaugugcuccaauggaucguugcaaugcagaauuugcauuuaa

SEQ ID NO: 31466 - RNA, 1701 nt, Artificial Sequence
  hemagglutinin__InfluenzaA__ABG26758
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucaggguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacaucugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcauauauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 31467 - RNA, 1701 nt, Artificial Sequence
  hemagglutinin__InfluenzaA__ABG26769
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaauuccucaacagguaggauaugugacaguccucaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcggaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucagaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31468 - RNA, 1701 nt, Artificial Sequence
  hemagglutinin__InfluenzaA__ABG26780
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucacauaaugggaaaagcaguuuuuacaaaaauuugcuauggcugacggaaaagaauggcuuguacccaaaucugagcaaguccuauguaaacaacaaggagaaagaaguccuugugcuaugggguguucaucacccgucuaacauaggggaccaaagggccaucuaucauacagaaaaugcuuaugucucuguagugucuucacauuauagcagaagauucaccccagaaauaacaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaccaucaucagaaugaacaaggaucuggcuaugcugcagaccagaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggguuucuggacauuuggacauauaaugcagaguuguugguucuccuggaaaaugaaaggacuuuggauuuucaugacucaaaugugaagaaucuguaugagaaaguaaaaacccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31469 - RNA, 1701 nt, Artificial Sequence
  hemagglutinin__InfluenzaA__ABG26791
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugaaggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuauguuucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucagucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31470 - RNA, 1701 nt, Artificial Sequence
  hemagglutinin__InfluenzaA__ABG26802
augaagacuaucauugcuuugagcuacauuuccugucugguuuucgcccaaaaacuucccggaaaugacaacagcacagcaacgcugugccugggacaucaugcaguaccaaacggaacgcuagugaaaacaaucacgaaugaucagauugaagugacuaaugcuacugagcugguccaaaguuccucaacagguagaauaugcgacaguccucaccgaauccuugauggaaaaaacugcacacugauagaugcucuauugggagacccucauugugauggcuuccaaaaugagaaaugggaucuuuuuguugaacgcagcaaagcuuucagcaacugcuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguaugagucagaaagcaaauauccagcgcugaacgugacuaugccaaacaauggcaaauuugacaaauuguacauuugggggguucaccacccuagcacggacaaagaacaaaccaaccuauauguucgagcaucagggagagucacagucucuaccaagaggagccagcaaacuguaaucccgaauaucgggccuagacccuggguaaggggucugucuaguagaauaaguaucuauuggacaauaguaaaaccgggagacauacuguuaauuaauagcacugggaaccuaauugcuccccgggguuacuucaaaauacgcacugggaaaagcucaauaaugaggucagaugcaccuauuggcaccugcaguucuggaugcaucacuccaaauggaagcauucccaaugacaaacccuuucaaaaugugaacaagaucacauauggggcaugucccagguauguuaagcagaacacucugaaguuggcaacagggaugcggaauguaccugaaaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaguauguugaagacacuaaaauagaucucuggucuuacaacgcggagcuucuuguugcccuggagaaccaacauacaauugauaugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcucuguguuguuuugcugggguucauaaugugggccugccaaaaaggcaacauuaggugcaacauuugcauuuga

SEQ ID NO: 31471 - RNA, 1701 nt, Artificial Sequence; identical to SEQ ID NO: 31420
  hemagglutinin__InfluenzaA__ABG26813

SEQ ID NO: 31472 - RNA, 1701 nt, Artificial Sequence
  hemagglutinin__InfluenzaA__ABG26824
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuuuuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcaaaauaugcaucuga

SEQ ID NO: 31473 - RNA, 1701 nt, Artificial Sequence
  hemagglutinin__InfluenzaA__ABG26835
augaaagcaaaacuacugguccuguuaugugcacuuucagcuacagaugcagacacaauauguauaggcuaccaugcgaacaacucaaccgacacuguugacacagugcucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31474 - RNA, 1701 nt, Artificial Sequence
  hemagglutinin__InfluenzaA__ABG26890
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaauuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31475 - RNA, 1701 nt, Artificial Sequence
  hemagglutinin__InfluenzaA__ABG26901
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaauuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuauucuugcaaaaggggaucuguuaacaguuucuuuaguagauugaauugguugcacaaaucagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagagaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31476 - RNA, 1701 nt, Artificial Sequence
  hemagglutinin__InfluenzaA__ABG26912
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuagcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauagguuaaucgagaaaacgaacgaaaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31477 - RNA, 1698 nt, Artificial Sequence
  hemagglutinin__InfluenzaA__ABG26945
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaguggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31478 - RNA, 1701 nt, Artificial Sequence
  hemagglutinin__InfluenzaA__ABG26956
augaagacuaucauugcuuugagcuacauuuuaugccugguuuucgcucaaaaacuucccggaaaugacaaccgcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccccauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguaaauugaauugguugcaccaauuaaaauauaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaagcugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31479 - RNA, 1698 nt, Artificial Sequence
  hemagglutinin__InfluenzaA__ABG37120
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaauggggaaagcaguuuuuacagaaauuugcuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacccaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31480 - RNA, 1701 nt, Artificial Sequence
  hemagglutinin__InfluenzaA__ABG37131
augaagacuaucauugcuuugagcuacauuucaugucugguuuucgcucaaaaacuucccggaaaugacaacagcacggcaacgcugugccugggacaccaugcagugccaaacgggacgcuagugaaaacaaucacgaaugaccaaauugaagugacuaaugcuacugagcugguucagaguuccucaacagguagaauaugcgacgguccucaccaaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucuuccggcacccuggaguuuaccaaugaaagcuucaauuggacuggagucgcucagaauggaacaagcuaugcuugcaaaaggggaucuguuaaaaguuucuuuaguagauugaauugguugcacaaauuagaauacaaauauccagcacuaaacgugacuaugccaaacaaugacaaauuugacaaauuguacauuugggggguucaccacccgaguacggacagugaccaaaccagccuauauguucaaucaucagggagagucacagucucuaccaaaagaagccaacaaacuguaaccccgaauaucgggucuagacccuggguaagggguaucuccagcagaauaagcaucuauuggacaauaguaaaaccgggagacauacuuuugauuaacagcacagggaaucuaauugcuccucgggguuacuucaaaauacgaagggggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuucaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugcaugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31481 - RNA, 1701 nt, Artificial Sequence
  hemagglutinin__InfluenzaA__ABG37142
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucaggguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcauauauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacggaaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 31482 - RNA, 1701 nt, Artificial Sequence
  hemagglutinin__InfluenzaA__ABG37164
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaauugcacacugauagaugcucuauugggagacccucauugugaugacuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauaggcuaaucgagaaaacgaacgaaaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuucugcuuuguguuguuuugcugggguucaucaugugggccugccaaaaaggcaacauuaggugcaacauuugcauuuga

SEQ ID NO: 31483 - RNA, 1701 nt, Artificial Sequence
  hemagglutinin__InfluenzaA__ABG37175
augaagacuaucauugcuuugagcuacauuuuaugucagguuuucgcuaaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuauucuugcaaaaggggaucuguuaacaguuucuuuaguagauugaauugguugcacaaauuagaauacaaauauccagcacugaacgugacuaugccaaacaaugacaaauuugauaaauuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucgggauacaaagauuggauccuauggauuucuuuugccauaucaugcuuuuugcuuuguguuguuuugcugggguucaucaugugggccugccaaaaaggcaacauuaggugcaacauuugcauuuga

SEQ ID NO: 31484 - RNA, 1701 nt, Artificial Sequence
  hemagglutinin__InfluenzaA__ABG37186
augaagacuaucauugcuuugagcuacauuuuaugucagguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuagcagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacagggucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacaaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguguacaaagacgaagcauuaaacaaccgguuccagaucaaagguguugugcugaagucgggauacaaagauuggauccuauggauuucuuuugccauaucaugcuuuuugcuuuguguuguuuugcugggguucaucaugugggccugccaaaaaggcaacauuaggugcaacauuugcauuuga

SEQ ID NO: 31485 - RNA, 1701 nt, Artificial Sequence
  hemagglutinin__InfluenzaA__ABG37197
augaagacuaucauugcuuugagcuacauuuuaugucagguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggaauggagucgcucaggaugggaaaagcuaugcuugcaaaaggggaucuguuaaaaguuucuuuaguagauugaauugguugcacaaauuagaauacaaauauccagcacugaacgugacuaugccaaacaaugacaaauuugauaaauuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucgggauacaaagauuggauccuauggauuucuuuugccauaucaugcuuuuugcuuuguguuguuuugcugggguucaucaugugggccugccaaaaaggcaacauuaggugcaacauuugcauuuga

SEQ ID NO: 31486 - RNA, 1701 nt, Artificial Sequence
  hemagglutinin__InfluenzaA__ABG37208
augaagacuaucauugcuuugagcuacauuuccugucugguuuucgcccaaaaacuucccggaaaugacaacagcacagcaacgcugugccugggacaucaugcaguaccaaacggaacgcuagugaaaacaaucacgaaugaucagauugaagugacuaaugcuacugagcugguccaaaguuccucaacagguagaauaugcgacaguccucaccgaauccuugauggaaaaaacugcacacugauagaugcucuauugggagacccucauugugauggcuuccaaaaugagaaaugggaucuuuuuguugaacgcagcaaagcuuucagcaacugcuacccuuaugaugugccggauuaugccucccuuaggucacuaguugccucaucaggcacccuggaguuuaucaaugaaggcuucaauuggacuggagucacucagagugggggaagcuaugcuugcaaaaggggaucuguuaacaguuucuucaguagauugaauugguuguauaagucagaaagcaaauauccagcgcugaacgugacuaugccaaacaauggcaaauuugacaaauuguacauuugggggguucaccacccuagcacggacaaagaacaaaccaaccuauauguucgagcaucagggagagucacagucucuaccaagagaagccagcaaacuguaaucccgaauaucgggccuagacccuggguaaggggucugucuaguagaauaaguaucuauuggacaauaguaaaaccgggagacauacuguuaauuaauagcacugggaaccuaauugcuccccgggguuacuucaaaauacgcacugggaaaagcucaauaaugaggucagaugcaccuauuggcaccugcaguucuggaugcaucacuccaaauggaagcauucccaaugacaaacccuuucaaaaugugaacaagaucacauauggggcaugucccagguauguuaagcagaacacucugaaguuggcaacagggaugcggaauguaccugaaaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaguauguugaagacacuaaaauagaucucuggucuuacaacgcggagcuucuuguugcccuggagaaccaacauacaauugauaugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcucuguguuguuuugcugggguucauaaugugggccugccaaaaaggcaacauuaggugcaacauuugcauuuga

SEQ ID NO: 31487 - RNA, 1701 nt, Artificial Sequence
  hemagglutinin__InfluenzaA__ABG37230
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaauuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcaccaaucaaaauacaaauauccagagcugaacgugacuaugccaaacaauggcaaauuugacaaauuguacauuugggggguucaccacccgagcacggacagugaccaaaccagccuauaugcucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcaccaauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccuugagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31488 - RNA, 1701 nt, Artificial Sequence
  hemagglutinin__InfluenzaA__ABG37241
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuucaaaauaaggaaugggaccuuuuuguugaacgcagcaaagcuuacagcaacuguuacccuuaugaugugccggauuaugccucccuuaggucacuaguugccucaucaggcacccuggaauuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31489 - RNA, 1701 nt, Artificial Sequence
  hemagglutinin__InfluenzaA__ABG37252
augaagacuaucauugcuuugagcuacauuuuaugucugguuuucgcucaaaaacuuaccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31490 - RNA, 1701 nt, Artificial Sequence
  hemagglutinin__InfluenzaA__ABG37263
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauagguuaaucgagaaaacgaacgaaaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaauaccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31491 - RNA, 1701 nt, Artificial Sequence
  hemagglutinin__InfluenzaA__ABG37274
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaucagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaguagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31492 - RNA, 1701 nt, Artificial Sequence
  hemagglutinin__InfluenzaA__ABG37285
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagacuacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguuuuguuuugcuuggguucaucaugugggccugccaaaaaggcaacauuaggugcaacauuugcauuuga

SEQ ID NO: 31493 - RNA, 1701 nt, Artificial Sequence
  hemagglutinin__InfluenzaA__ABG37296
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcuccauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaauugagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggguacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31494 - RNA, 1701 nt, Artificial Sequence
  hemagglutinin__InfluenzaA__ABG37307
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuugaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuguggauuuccuuugccauaucaugcuuuuugcuuuguguuguuuugcuuggguucaucaugugggccugccaaaaaggcaacauuaggugcaacauuugcauuuga

SEQ ID NO: 31495 - RNA, 1701 nt, Artificial Sequence
  hemagglutinin__InfluenzaA__ABG37318
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauagguuaaucgagaaaacgaacgaaaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31496 - RNA, 1701 nt, Artificial Sequence
  hemagglutinin__InfluenzaA__ABG37329
augaagacuaucauugcuuugagcuacauuuuaugucugguuuucgcucaaaaacuucccgaaaaugacaacagcacagcaacgcugugccugggacaccaugcagugccaaacggaacgcuaguuaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31497 - RNA, 1701 nt, Artificial Sequence
  hemagglutinin__InfluenzaA__ABG37340
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuucccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuauucuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31498 - RNA, 1701 nt, Artificial Sequence
  hemagglutinin__InfluenzaA__ABG37351
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauugauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguaaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31499 - RNA, 1698 nt, Artificial Sequence
  hemagglutinin__InfluenzaA__ABG37362
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucggcaucaugcucccauaaugggaaaagcaguuuuuaccgaaauuugcuauggcugacggggaagaaugguuuguacccaaaccugagcaaguccuaugcaaacaacaaagagaaagaaguccuuguacuaugggguguucaucacccgccuaacauagggaaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaauuuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31500 - RNA, 1698 nt, Artificial Sequence; identical to SEQ ID NO: 31304
  hemagglutinin__InfluenzaA__ABG37384

SEQ ID NO: 31501 - RNA, 1698 nt, Artificial Sequence
  hemagglutinin__InfluenzaA__ABG37395
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaagaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31502 - RNA, 1701 nt, Artificial Sequence; identical to SEQ ID NO: 31282
  hemagglutinin__InfluenzaA__ABG37406

SEQ ID NO: 31503 - RNA, 1701 nt, Artificial Sequence
  hemagglutinin__InfluenzaA__ABG37428
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccugggugaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaaucccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31504 - RNA, 1701 nt, Artificial Sequence; identical to SEQ ID NO: 31066
  hemagglutinin__InfluenzaA__ABG37439

SEQ ID NO: 31505 - RNA, 1701 nt, Artificial Sequence
  hemagglutinin__InfluenzaA__ABG37461
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguaaauugaauugguugcaccaauuaaaauauaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaagcugaauagguuaaucgagaaaacgaaugagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31506 - RNA, 1701 nt, Artificial Sequence
  hemagglutinin__InfluenzaA__ABG37472
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaguccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaucaauuaaaauacaaauauccagcacugaaugugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31507 - RNA, 1701 nt, Artificial Sequence
  hemagglutinin__InfluenzaA__ABG37483
augaagacuaucauugcuuugagcuauauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaauuagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31508 - RNA, 1701 nt, Artificial Sequence
  hemagglutinin__InfluenzaA__ABG37494
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguaaauugaauugguugcaccaauuaaaauauaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaagcugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31509 - RNA, 1701 nt, Artificial Sequence
  hemagglutinin__InfluenzaA__ABG37505
augaagacuaucauugcuuugagcuacauuuuaugucugguuuucgcucaaaaacuucccggaaaugacaacagcauggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaaaugcaauucugaaugcaucacuccaaauggaagcauucccaaugacaaaccauuucaaaauguaaacaggaucacauaugggcucugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31510 - RNA, 1701 nt, Artificial Sequence; identical to SEQ ID NO: 31024
  hemagglutinin__InfluenzaA__ABG37516

SEQ ID NO: 31511 - RNA, 1701 nt, Artificial Sequence; identical to SEQ ID NO: 31024
  hemagglutinin__InfluenzaA__ABG37527

SEQ ID NO: 31512 - RNA, 1701 nt, Artificial Sequence; identical to SEQ ID NO: 31024
  hemagglutinin__InfluenzaA__ABG37538

SEQ ID NO: 31513 - RNA, 1701 nt, Artificial Sequence; identical to SEQ ID NO: 31024
  hemagglutinin__InfluenzaA__ABG37549

SEQ ID NO: 31514 - RNA, 1701 nt, Artificial Sequence
  hemagglutinin__InfluenzaA__ABG37560
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugccccagauauguuaagcaaaacacucugaaguuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31515 - RNA, 1701 nt, Artificial Sequence; identical to SEQ ID NO: 31024
  hemagglutinin__InfluenzaA__ABG37571

SEQ ID NO: 31516 - RNA, 1701 nt, Artificial Sequence
  hemagglutinin__InfluenzaA__ABG37582
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31517 - RNA, 1701 nt, Artificial Sequence
  hemagglutinin__InfluenzaA__ABG37604
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugccccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31518 - RNA, 1701 nt, Artificial Sequence; identical to SEQ ID NO: 31024
  hemagglutinin__InfluenzaA__ABG37615

SEQ ID NO: 31519 - RNA, 1698 nt, Artificial Sequence; identical to SEQ ID NO: 31246
  hemagglutinin__InfluenzaA__ABG47807

SEQ ID NO: 31520 - RNA, 1698 nt, Artificial Sequence; identical to SEQ ID NO: 31245
  hemagglutinin__InfluenzaA__ABG47818

SEQ ID NO: 31521 - RNA, 1701 nt, Artificial Sequence
  hemagglutinin__InfluenzaA__ABG47829
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucacauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauaacaaaaagacccaaaguaagaaaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaccaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggguuucuggacauuuggacauauaaugcagaguuguugguucuccuggaaaaugaaaggacuuuggauuuucaugacucaaaugugaagaaucuguaugagaaaguaaaaacccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31522 - RNA, 1701 nt, Artificial Sequence
  hemagglutinin__InfluenzaA__ABG47840
augaaaguaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugagugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagaccaaaaaagcacacaaaaugccauugaugggauuacaaacaaggugaauucuguaauugagaaaaugaacacucaauucacggcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggcgucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31523 - RNA, 1701 nt, Artificial Sequence
  hemagglutinin__InfluenzaA__ABG47851
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaacuguacauuugggggguucaccacccgagcacggacagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguggaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuauaaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcagcauuugcauuuga

SEQ ID NO: 31524 - RNA, 1701 nt, Artificial Sequence
  hemagglutinin__InfluenzaA__ABG47862
augaggacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcaacaguccucaucgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugcuucccuuaggucacuaauugccucauccggcacccuggaguuuaccaaugaaggcuucaauuggacuggagucgcucaggauggaacaagcuaugcuugcaaaaggggaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucgggucuagacccuggguaagggguguuuccagcaggauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaaucgaaaaagaauucucagaaguagaagggagaauucaggaccucgagaaauauguugaagacacuaaaauagaccucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31525 - RNA, 1701 nt, Artificial Sequence
  hemagglutinin__InfluenzaA__ABG47873
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggauaacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuugugugguuuugcuuggguucaucaugugggccugccaaaaaggcaacauuaggugcaacauuugcauuuga

SEQ ID NO: 31526 - RNA, 1701 nt, Artificial Sequence; identical to SEQ ID NO: 31495
  hemagglutinin__InfluenzaA__ABG47895

SEQ ID NO: 31527 - RNA, 1701 nt, Artificial Sequence
  hemagglutinin__InfluenzaA__ABG47906
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31528 - RNA, 1701 nt, Artificial Sequence
  hemagglutinin__InfluenzaA__ABG47917
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauacccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaccuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31529 - RNA, 1701 nt, Artificial Sequence
  hemagglutinin__InfluenzaA__ABG47928
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31530 - RNA, 1701 nt, Artificial Sequence
  hemagglutinin__InfluenzaA__ABG47939
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccuuaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31531 - RNA, 1701 nt, Artificial Sequence
  hemagglutinin__InfluenzaA__ABG47950
augaagacuaucauugcuuugagcuacauucuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauuaggcacccuggaguuuaucaaugaagacuucaauuggacuggagucgcucaggauggaaaaagcuauucuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauaugcucgagcaucagggagagucacagucucuaccaaaagaagccaacaaacuguaaucccgaauaucggguuuagacccuggguaaggggucuguccaguagaauaagcaucuauuggacaauaguaaagccgggagacauacuuuugauuaauagcacagggaaucuaauugcuccucgggguuacuucaaaauacggacugggaaaagcucaauaaugaggucagaugcacccauuggcaacugcaguucugaaugcaucacuccaaauggaaacauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucagaucgaaaaagaauucucagaaguagaagggagaauucaggaccucgagaaauauguugaagacacuaaaauagaucucuggucuuacaacgcgggguuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuuguugggguucaucaugugggccugccaaaaaggcaacauuaggugcaacauuugcauuuga

SEQ ID NO: 31532 - RNA, 1701 nt, Artificial Sequence
  hemagglutinin__InfluenzaA__ABG47961
augaagacuaucauugcuuugagcuacauuuuaugucugguuuucgcucaaaaacuccccggaaaugacaacagcacagcaacgcugugccugggacaccaugcagugccaaacggaacgcuagugaagacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuauucuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggggagucacagucucuaccaaaagaagccaacaaacuguaaucccgaauaucggguccagacccuggguaaggggucuguccaguagaauaagcaucuauuggacaauaguaaaaccgggagacauacuuuugauuaauagcacagggaaucuaauugcuccucgggguuacuucaaaaugcgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgguaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagagaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31533 - RNA, 1701 nt, Artificial Sequence
  hemagglutinin__InfluenzaA__ABG47972
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31534 - RNA, 1701 nt, Artificial Sequence
  hemagglutinin__InfluenzaA__ABG47983
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31535 - RNA, 1701 nt, Artificial Sequence
  hemagglutinin__InfluenzaA__ABG47994
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31536 - RNA, 1701 nt, Artificial Sequence
  hemagglutinin__InfluenzaA__ABG48005
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauacguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaaccuaugaccaugauguauacagagaugaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31537 - RNA, 1701 nt, Artificial Sequence; identical to SEQ ID NO: 31529
  hemagglutinin__InfluenzaA__ABG48016

SEQ ID NO: 31538 - RNA, 1701 nt, Artificial Sequence; identical to SEQ ID NO: 31529
  hemagglutinin__InfluenzaA__ABG48027

SEQ ID NO: 31539 - RNA, 1698 nt, Artificial Sequence
  hemagglutinin__InfluenzaA__ABG48049
augaaaguaaaacuacugguccuguuauguacauuuacagcuacauaugcagacacaauauguauaggguaccaugccaacaacucaaccgacacuguugacacaguacuugagaagaaugugacagugacacacucugucaacuuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuacacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuucagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31540 - RNA, 1701 nt, Artificial Sequence
  hemagglutinin__InfluenzaA__ABG48060
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaagccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuauuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31541 - RNA, 1701 nt, Artificial Sequence; identical to SEQ ID NO: 31271
  hemagglutinin__InfluenzaA__ABG48071

SEQ ID NO: 31542 - RNA, 1701 nt, Artificial Sequence
  hemagglutinin__InfluenzaA__ABG48082
augaagacuaucauugcuuugagcuacauuuuaugccugguuuucgcucaaaaacuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucuccacccggguacagacagugaccaaaucagccuauaugcucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 31543 - RNA, 1701 nt, Artificial Sequence
  hemagglutinin__InfluenzaA__ABG48104
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcagagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaauuccgaauaucggaucuagacccuggguaaggggugucuccagcagaauaagcaucuauuggacaauaguaaaaccgggagacauacuuuugauuaacagcacagggaaucuaauugcuccuagggguuacuucaaaauacgaagugggaaaaguucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaauugcggguuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaauuagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31544 - RNA, 1701 nt, Artificial Sequence; identical to SEQ ID NO: 31508
  hemagglutinin__InfluenzaA__ABG48115

SEQ ID NO: 31545 - RNA, 1701 nt, Artificial Sequence
  hemagglutinin__InfluenzaA__ABG48126
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccauaauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31546 - RNA, 1701 nt, Artificial Sequence
  hemagglutinin__InfluenzaA__ABG48148
augaagacuaucauugcuuugagcuauauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31547 - RNA, 1701 nt, Artificial Sequence
  hemagglutinin__InfluenzaA__ABG48159
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugagcgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcuaaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31548 - RNA, 1701 nt, Artificial Sequence
  hemagglutinin__InfluenzaA__ABG48170
augaagacuaucauugcuuugagcuacauuuuaugccugguuuuugcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaaguuucaauuggacuggagucgcucagaauggaacaagcucugcuugcaaaaggagaucugauaaaaguuucuuuaguagacugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaagucagaugcacccauuggcaaaugcaauuuugaaugcaucacuccaaauggaagcauucccaauggcaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaccagaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugaacugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 31549 - RNA, 1701 nt, Artificial Sequence
  hemagglutinin__InfluenzaA__ABG48181
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcuaugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31550 - RNA, 1701 nt, Artificial Sequence
  hemagglutinin__InfluenzaA__ABG48192
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugagcgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguuacaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaagugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagauuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcuaaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31551 - RNA, 1701 nt, Artificial Sequence
  hemagglutinin__InfluenzaA__ABG48203
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacguuugcauuuga

SEQ ID NO: 31552 - RNA, 1701 nt, Artificial Sequence; identical to SEQ ID NO: 31024
  hemagglutinin__InfluenzaA__ABG48214

SEQ ID NO: 31553 - RNA, 1701 nt, Artificial Sequence; identical to SEQ ID NO: 31024
  hemagglutinin__InfluenzaA__ABG48236

SEQ ID NO: 31554 - RNA, 1701 nt, Artificial Sequence
  hemagglutinin__InfluenzaA__ABG48247
augaagacuaucauugcuuugagcuacauucuaugucugguuuucgcucaaaaacuucccggaaaugacaacaacacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugccccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31555 - RNA, 1701 nt, Artificial Sequence
  hemagglutinin__InfluenzaA__ABG48269
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugaacugguucagaguuccccaacagguggaauaugcgacaguccucaucagauccuugauggagaaaacugcacacuaauagaugcucuauugggagacccucagugugauggcuuccaaaauaagaaaugggaccuuuuugucgaacgcagcaaagcccacagcaacuguuacccuuaugaugugccggauuaugccucccuuaggucacuaguugccucauccggcacacuggaguuuaacaaugaaagcuucaauuggacuggagucacucaaaauggaacaaguucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaacguaaacaggaucacauauggggccugucccagauauguuaagcaaaacacucugaaauuggcaacagggaugcgaaacguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucaaauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31556 - RNA, 1701 nt, Artificial Sequence
  hemagglutinin__InfluenzaA__ABG48291
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaaucagaauacaaauacccagcgcugaacgugucuaugccaaacaauggcaaauuuaacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaccugcaguuuugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31557 - RNA, 1701 nt, Artificial Sequence
  hemagglutinin__InfluenzaA__ABG48335
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31558 - RNA, 1701 nt, Artificial Sequence
  hemagglutinin__InfluenzaA__ABG48346
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcaacaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacagaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31559 - RNA, 1701 nt, Artificial Sequence
  hemagglutinin__InfluenzaA__ABG48357
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguuccgaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31560 - RNA, 1701 nt, Artificial Sequence
  hemagglutinin__InfluenzaA__ABG48368
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguggcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauaagaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaguauaccacaaaugugacaaugccugcauagagucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31561 - RNA, 1701 nt, Artificial Sequence
  hemagglutinin__InfluenzaA__ABG67135
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacagaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31562 - RNA, 1701 nt, Artificial Sequence; identical to SEQ ID NO: 31392
  hemagglutinin__InfluenzaA__ABG67146

SEQ ID NO: 31563 - RNA, 1701 nt, Artificial Sequence
  hemagglutinin__InfluenzaA__ABG67157
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcaacaguccucaccggaucauugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacacuggaguuuaucaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggagagucacagucucuaccaaaagaagccaacaaacuguaaucccagauaucggguauagaccauggguaagaggucuguccaguagaauaagcaucuauuggacaauaguaaaaccgggagacauacuuuugauuaauagcacagggaaucuaauugcuccucgggguuacuucaaacuacgaaaugggaaaagcucaauaaugaggucagaugcacccauuggcaacugcaguucugaaugcaucacuccaaauggaagcauucccaaugacaaaccuuuucaaaauguaaacaggaucacuuauggggccugccccagauauauuaagcaaaacacucugaaauuggcaacagggaugcggaauguaccagagaaacaaacuagaggcauauuuggcgcaaucgcagguuucauagaaaaugguugggagggaaugguagacgguugguacgguuucaggcaucaaaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuguuugaaagaacaaagaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31564 - RNA, 1701 nt, Artificial Sequence
  hemagglutinin__InfluenzaA__ABG67168
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuuuccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagagaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31565 - RNA, 1701 nt, Artificial Sequence; identical to SEQ ID NO: 31527
  hemagglutinin__InfluenzaA__ABG67179

SEQ ID NO: 31566 - RNA, 1701 nt, Artificial Sequence
  hemagglutinin__InfluenzaA__ABG67190
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuucccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31567 - RNA, 1701 nt, Artificial Sequence
  hemagglutinin__InfluenzaA__ABG67212
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacagauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31568 - RNA, 1701 nt, Artificial Sequence
  hemagglutinin__InfluenzaA__ABG67223
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgaaaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31569 - RNA, 1701 nt, Artificial Sequence
  hemagglutinin__InfluenzaA__ABG67234
augaagacuaucauugcuuugagcuacauuuuaugucugguuuucgcucaaaaacuucccggagaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguagaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31570 - RNA, 1701 nt, Artificial Sequence
  hemagglutinin__InfluenzaA__ABG67245
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaauugcagguuucauagaaaaugguugggagggaaugguagacgguugguacgguuucaggcaucaaaauucugagggcacaggacaagcagcagaucuuaaaagcacucaagcagcaaucgaccaaaucgacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31571 - RNA, 1698 nt, Artificial Sequence; identical to SEQ ID NO: 31246
  hemagglutinin__InfluenzaA__ABG67477

SEQ ID NO: 31572 - RNA, 1698 nt, Artificial Sequence; identical to SEQ ID NO: 31304
  hemagglutinin__InfluenzaA__ABG67491

SEQ ID NO: 31573 - RNA, 1701 nt, Artificial Sequence
  hemagglutinin__InfluenzaA__ABG67502
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugucggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31574 - RNA, 1701 nt, Artificial Sequence
  hemagglutinin__InfluenzaA__ABG67524
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcagagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaauuccgaauaucggaucuagacccuggguaaggggugucuccagcagaauaagcaucuauuggacaauaguaaaaccgggagacauacuuuugauuaacagcacagggaaucuaauugcuccuagggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcagucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaauuagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31575 - RNA, 1701 nt, Artificial Sequence
  hemagglutinin__InfluenzaA__ABG67535
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcaguaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31576 - RNA, 1701 nt, Artificial Sequence; identical to SEQ ID NO: 31024
  hemagglutinin__InfluenzaA__ABG67546

SEQ ID NO: 31577 - RNA, 1701 nt, Artificial Sequence
  hemagglutinin__InfluenzaA__ABG67557
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcaacaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31578 - RNA, 1701 nt, Artificial Sequence; identical to SEQ ID NO: 31514
  hemagglutinin__InfluenzaA__ABG67568

SEQ ID NO: 31579 - RNA, 1701 nt, Artificial Sequence
  hemagglutinin__InfluenzaA__ABG67579
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31580 - RNA, 1701 nt, Artificial Sequence; identical to SEQ ID NO: 31024
  hemagglutinin__InfluenzaA__ABG67590

SEQ ID NO: 31581 - RNA, 1701 nt, Artificial Sequence; identical to SEQ ID NO: 31042
  hemagglutinin__InfluenzaA__ABG67601

SEQ ID NO: 31582 - RNA, 1701 nt, Artificial Sequence; identical to SEQ ID NO: 31514
  hemagglutinin__InfluenzaA__ABG67612

SEQ ID NO: 31583 - RNA, 1701 nt, Artificial Sequence; identical to SEQ ID NO: 31514
  hemagglutinin__InfluenzaA__ABG67623

SEQ ID NO: 31584 - RNA, 1701 nt, Artificial Sequence
  hemagglutinin__InfluenzaA__ABG67634
augaagacuaucauugcuuugagcuacauucuaugucugguuuucgcucaaaaacuucccggaaaugacaacaacacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugccccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucaaaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31585 - RNA, 1701 nt, Artificial Sequence
  hemagglutinin__InfluenzaA__ABG67645
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugauucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31586 - RNA, 1701 nt, Artificial Sequence
  hemagglutinin__InfluenzaA__ABG67656
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauugggcuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaauagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaucgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31587 - RNA, 1701 nt, Artificial Sequence
  hemagglutinin__InfluenzaA__ABG67667
augaagacuaucauugcuuugagcuacauuuuaugucagguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacuaauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggauuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggauagugaccaaaccagccuauauguucaagcaucagggagagucacagucucuaccaaaagaagccaacaaacuguaaucccgaauaucggguccagacccugggugaggggcaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauugacaacugcaauucugaaugcaucacuccaaauggaagcauucccaaugacaaaccuuuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugauagacgguugguacgguuucaggcaucaaaauucugagggcacaggacaagcagcagaucuuaaaagcacucaagcagcaaucgaucaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaucaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucgggauacaaagauuggauccuauggauuucuuuugccauaucaugcuuuuugcuuuguguuguuuugcugggguucaucaugugggccugccaaaaaggcaacauuaggugcaacauuugcauuuga

SEQ ID NO: 31588 - RNA, 1701 nt, Artificial Sequence
  hemagglutinin__InfluenzaA__ABG79941
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcagcauuugcauuuga

SEQ ID NO: 31589 - RNA, 1701 nt, Artificial Sequence; identical to SEQ ID NO: 31425
  hemagglutinin__InfluenzaA__ABG79952

SEQ ID NO: 31590 - RNA, 1701 nt, Artificial Sequence
  hemagglutinin__InfluenzaA__ABG79974
augaagacuaucauugcuuugagcuacauuuuaugccugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31591 - RNA, 1701 nt, Artificial Sequence; identical to SEQ ID NO: 31527
  hemagglutinin__InfluenzaA__ABG79985

SEQ ID NO: 31592 - RNA, 1701 nt, Artificial Sequence
  hemagglutinin__InfluenzaA__ABG79996
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuauucuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcagcugagggaaaaugcugaggacaugggcaaugguuguuucaaaauauaccacaaaugugacaaugccugcauagggucaaucagaaauggaaccuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31593 - RNA, 1701 nt, Artificial Sequence; identical to SEQ ID NO: 31527
  hemagglutinin__InfluenzaA__ABG80007

SEQ ID NO: 31594 - RNA, 1701 nt, Artificial Sequence; identical to SEQ ID NO: 31527
  hemagglutinin__InfluenzaA__ABG80018

SEQ ID NO: 31595 - RNA, 1701 nt, Artificial Sequence; identical to SEQ ID NO: 31495
  hemagglutinin__InfluenzaA__ABG80029

SEQ ID NO: 31596 - RNA, 1701 nt, Artificial Sequence; identical to SEQ ID NO: 31495
  hemagglutinin__InfluenzaA__ABG80040

SEQ ID NO: 31597 - RNA, 1701 nt, Artificial Sequence
  hemagglutinin__InfluenzaA__ABG80051
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugaccaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31598 - RNA, 1701 nt, Artificial Sequence
  hemagglutinin__InfluenzaA__ABG80062
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauagguuaaucgagaaaacgaacgaaaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagacaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31599 - RNA, 1701 nt, Artificial Sequence
  hemagglutinin__InfluenzaA__ABG80073
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucacagaauccuugaugggaaaaacugcacacugauagaugcucuauugggagacccuaauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacaggaaaucuaauugcuccucgggguuacuucaaaauacgaaaugggaaaagcucaauaaugaggucagaugcacccauuggcaccugcaguucugaaugcaucacuccaaauggaagcauucccaaugacaaaccuuuucaaaauguaaacaggaucacauauggggccugccccagauacguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31600 - RNA, 1701 nt, Artificial Sequence
  hemagglutinin__InfluenzaA__ABG80084
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguggaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaagaaagcaacugagggaaaaugcugaggacaugggcaaugguugcuucaaaauauaccacaaaugugacaaugccugcauagggucaaucagaaauggaacuuaugaccaugauauauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31601 - RNA, 1701 nt, Artificial Sequence
  hemagglutinin__InfluenzaA__ABG80095
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcacaaauuagaauacaaauauccagcgcugaacgugacuaugccaaacaauggcaaaguugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31602 - RNA, 1701 nt, Artificial Sequence
  hemagglutinin__InfluenzaA__ABG80106
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcccuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31603 - RNA, 1701 nt, Artificial Sequence
  hemagglutinin__InfluenzaA__ABG80117
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauacccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagugaaacaaacuagaggcauauucggcgcaaucgcagguuucauagaaaaugguugggagggaaugguagacgguugguacgguuucaggcaucaaaauucugagggcacaggacaagcagcagaccuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31604 - RNA, 1701 nt, Artificial Sequence
  hemagglutinin__InfluenzaA__ABG80128
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucgaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31605 - RNA, 1701 nt, Artificial Sequence
  hemagglutinin__InfluenzaA__ABG80139
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacuaauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcaccuauuggcaacugcaguuaugaaugcaucacuccaaauggaagcauucccaaugacaaaccuuuucaaaauguaaacaggaucacauauggggccugccccagauauguuaagcaaaacacucugaaguuggcaacggggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaauaccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31606 - RNA, 1701 nt, Artificial Sequence
  hemagglutinin__InfluenzaA__ABG80150
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaaaacuucaauuggacuggagucgcucaggaugggaaaagcuaugcuugcaaaaggggaucuguuaacaguuucuuuaguagauugaauuggcugcauaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguggaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacggaaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31607 - RNA, 1701 nt, Artificial Sequence
  hemagglutinin__InfluenzaA__ABG80161
augaagacuaucauugcuuugagcuacauuucaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaucgaauccuugauggaaaaaacugcacacugauagaugcucuauugggagacccucauugugauggcuuccaaaauaaggaaugggaccuuuuugucgaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucaagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31608 - RNA, 1698 nt, Artificial Sequence
  hemagglutinin__InfluenzaA__ABG80172
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccauaacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31609 - RNA, 1698 nt, Artificial Sequence
  hemagglutinin__InfluenzaA__ABG80183
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauagggggccaaagggcccucuaucauacagaaaaugcuuaugucucuguagugucaucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggagagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31610 - RNA, 1701 nt, Artificial Sequence
  hemagglutinin__InfluenzaA__ABG80194
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacgcuaauagaugcucuauugggagacccucauugugauggcuuccaaaauaaggaauggaaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31611 - RNA, 1701 nt, Artificial Sequence
  hemagglutinin__InfluenzaA__ABG80205
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacguggcuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauaaaucucuggucguacaacgcggagcuucuuguugcccuggagaaccagcauacaauugaucuaacugacucagaaaugaacaaacuauuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31612 - RNA, 1701 nt, Artificial Sequence
  hemagglutinin__InfluenzaA__ABG80216
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccccaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaauacacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcggguuucauagaaaaugguugggaaggaaugguggacgguugguacgguuucaggcaucaaaauucugagggcacaggacaagcagcagaucuuaaaagcacucaagcugcaaucaaccaaaucaacgggaaacugaauagguuaaucgagaaaacaaacgagaaauuccaucaaauugaaaaagaauucucagaaguagaagggagaauucaggaccucgagaaauauguugaggacaccaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31613 - RNA, 1701 nt, Artificial Sequence
  hemagglutinin__InfluenzaA__ABG80227
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguaaauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggcaugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaagcugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31614 - RNA, 1701 nt, Artificial Sequence; identical to SEQ ID NO: 31517
  hemagglutinin__InfluenzaA__ABG80238

SEQ ID NO: 31615 - RNA, 1701 nt, Artificial Sequence
  hemagglutinin__InfluenzaA__ABG80249
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuuacuuuguguugcuuuguugggguucaucaugugggccugccaaaaaggcaacauuaggugcaacauuugcauuuga

SEQ ID NO: 31616 - RNA, 1701 nt, Artificial Sequence; identical to SEQ ID NO: 31517
  hemagglutinin__InfluenzaA__ABG80260

SEQ ID NO: 31617 - RNA, 1701 nt, Artificial Sequence
  hemagglutinin__InfluenzaA__ABG80271
augaagacuaucauugcuuugagcuacauucuaugucugguuuucgcucaaaaacuucccggaaaugacaacagcacggcaacgcugugccuugggcaccaugcaguaccaaacggaacgguagugaaaacaaucacaaaugaccaaauugaaguuacuaaugcuacugagcugguucagaguuccucaacagguggaauaugcgacaguccucaucagauccuugauggagaaaacugcacacuaauggaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccaggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaaaaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31618 - RNA, 1701 nt, Artificial Sequence; identical to SEQ ID NO: 31095
  hemagglutinin__InfluenzaA__ABG80282

SEQ ID NO: 31619 - RNA, 1701 nt, Artificial Sequence; identical to SEQ ID NO: 30822
  hemagglutinin__InfluenzaA__ABG80293

SEQ ID NO: 31620 - RNA, 1701 nt, Artificial Sequence
  hemagglutinin__InfluenzaA__ABG80304
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucaaccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31621 - RNA, 1701 nt, Artificial Sequence
  hemagglutinin__InfluenzaA__ABG80315
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugauucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacaugcuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31622 - RNA, 1701 nt, Artificial Sequence
  hemagglutinin__InfluenzaA__ABG80326
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggaacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31623 - RNA, 1701 nt, Artificial Sequence; identical to SEQ ID NO: 30826
  hemagglutinin__InfluenzaA__ABG80337

SEQ ID NO: 31624 - RNA, 1701 nt, Artificial Sequence
  hemagglutinin__InfluenzaA__ABG80359
augaagacuaucauugcuuugagcuacauuuuaugucugguuuucgcucaaaaacuucccggaaaugacaacagcacagcaacgcugugccugggacaucaugcagugccaaacggaacgcuggugaaaacaaucacgaaugaucaaauugaagugacuaaugcuacugagcugguucagaguuccucaacagguagaauaugcgacaguccucaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccagugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcagucgaccaaaucaacgggaaacugaauagguuaaucgagagaacgaacgagaaauuucaucaaaucgaaaaagaauucucagaaguagaaggaagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31625 - RNA, 1701 nt, Artificial Sequence
  hemagglutinin__InfluenzaA__ABG80370
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaaaaguuucuuuaguagauugaauugguugcacaaauuagaguacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguuccgaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31626 - RNA, 1701 nt, Artificial Sequence
  hemagglutinin__InfluenzaA__ABG80392
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcacuaaacaaccgguuccagaucaaagguguugagcugaagucaggauacaaagauuggauccuauggauuuccuuugccauaucaugcuucuugcuuuguguuguuuugcugggguucaucaugugggccugccaaaaaggcaacauuaggugcaacauuugcauuuga

SEQ ID NO: 31627 - RNA, 1701 nt, Artificial Sequence; identical to SEQ ID NO: 31557
  hemagglutinin__InfluenzaA__ABG80403

SEQ ID NO: 31628 - RNA, 1701 nt, Artificial Sequence; identical to SEQ ID NO: 31557
  hemagglutinin__InfluenzaA__ABG80414

SEQ ID NO: 31629 - RNA, 1701 nt, Artificial Sequence
  hemagglutinin__InfluenzaA__ABG80425
augaagacuaucauugcuuugagcuacauuuuaugucugguuuucgcucaaaaacuucccggaaaugacaacagcacagcaacgcugugccugggacaccaugcagugccaaacggaacgcuagugaaaacaauuacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31630 - RNA, 1701 nt, Artificial Sequence
  hemagglutinin__InfluenzaA__ABG88289
augaagacuauuauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucaggguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaacaaugaaagcuucaauuggacuggagucgcccagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcauauauuggacaauaguaaaaccgggagacauacuuuugauuaacagcacagggaaucuaauugcuccucgggguuacuucaaaauacgaagugggaaaagcucaauaaugaggucagaugcacccauugacaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 31631 - RNA, 1701 nt, Artificial Sequence
  hemagglutinin__InfluenzaA__ABG88300
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggauccuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucacauaaugggaaaagcaguuuuuacaaaaauuugcuauggcugacggaaaagaauggcuuguacccagaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauaacaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaaugugcacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaccaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggguuucuggacauuuggacauauaaugcagaguuguugguucuccuggaaaaugaaaggacuuuggauuuucaugacucaaaugugaagaaucuguaugagaaaguaaaaacccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31632 - RNA, 1701 nt, Artificial Sequence; identical to SEQ ID NO: 31415
  hemagglutinin__InfluenzaA__ABG88311

SEQ ID NO: 31633 - RNA, 1701 nt, Artificial Sequence
  hemagglutinin__InfluenzaA__ABG88322
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucccacaaugggaaaagcaguuuuuacaaaaauuugcuauggcugacggaaaagaauggcuuguacccaauucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagagaucaagaagggagaaucaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagaccaaaaaagcacacaaaaugccauugaugggauuacaaacaaggugaauucuguaaucgaaaaaaugaacacucaauucacagcuguaggcaaagaauucaacaaauuagagagaaggauggaaaacuuaaauaagaaaguugaugauggauuucuagacauuuggacauauaaugcagaguuguugguucuccuggaaaaugaaaggacuuuggauuuucacgacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacugguacuuuuggucucccugggggcaaucaguuucuggauguguucuaaugggucuuugcaguguagaauaugcaucuga

SEQ ID NO: 31634 - RNA, 1701 nt, Artificial Sequence
  hemagglutinin__InfluenzaA__ABG88333
augaaagcaaaacuacugguccuguuaugugcacuuucagcuacagaugcagacacaauauguauaggcuaccaugcgaacaacucaaccgauacuguugacacaguacucgaaaagaacgugacagugacacacucugucaaccuacuugaggacagucacaacggaaaacuaugcagacuaaaaggaauagccccacuacaauuggggaaaugcagcauugcaggauggaucuuaggaaacccagaaugugaaucacuguuuucuaagaaaucaugguccuacauugcagaaacaccaaacuccgagaauggaacauguuacccaggguauuucgccgacuaugaggaacugagggagcaauugaguucaguaucaucuuucgagagauucgaaauauuccccaaggaaaguucauggcccaaacacaacguaaccagaggaguaacggcaucaugcucccauaaggggaaaagcaguuuuuacagaaauuugcuauggcugacggagaaaaauggcucguacccaaaucugagcaaguccuauguuaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauaucaaaacgacccaaaguaagaggucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaaugcaucgauggaugaaugugacgcgaagugucaaacaccccagggagcuauaaacaguagucuuccuuuccagaauguacacccagucacaauaggagagugcccaaaauacgucaggaguacaaaauuaaggaugguuacagggcuaaggaacaucccauccauucaauccagagguuuguuuggagccauugccgguuucauugaagggggauggacuggaaugauagauggaugguaugguuaucaucaucagaaugaacagggaucuggcuaugcugcagaucaaaaaagcacacaaaaugccauuaacgggauuacaaacaaggugaacucuguuaucgagaaaaugaacacucaauucacagcuguagguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31635 - RNA, 1701 nt, Artificial Sequence
  hemagglutinin__InfluenzaA__ABG88344
augaaagcaaaacuacugguccuguuaugugcacuuucagcuacagaugcagacacaauauguauaggcuaccaugcgaacaacucaaccgauacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugugaaucacuguuuucuaagaaaucaugguccuacauugcagaaacaccaaacuccgagaauggaacauguuacccaggguauuucgccgacuaugaggaacugagggagcaauugaguucaguaucaucuuucgagagauucgaaauauuccccaaggaaaguucauggcccaaacacaacguaaccagaggaguaacggcaucaugcucccauaaggggaaaagcaguuuuuacagaaauuugcuauggcugacggagaaaaauggcucguacccaaaucugagcaaguccuauguuaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauaucaaaacgacccaaaguaagaaaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacgcgaagugucaaacaccccagggagcuauaaacaguagucuuccuuuccagaauguacacccagucacaauaggagagugcccaaaauacgucaggaguacaaaauuaaggaugguuacaggacuaaggaacaucccauccauucaauccagagguuuguuuggagccauugccgguuucauugaagggggauggacuggaaugauagauggaugguaugguuaucaucaucagaaugaacagggaucuggcuaugcugcagaucaaaaaagcacacaaaaugccauuaacgggauuacaaacaaggugaacucuguuaucgagaaaaugaacacucaauucacagcuguagguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31636 - RNA, 1701 nt, Artificial Sequence
  hemagglutinin__InfluenzaA__ABG88355
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuuuccaguagaauaagcaucuauuggacaauaguaaaaccgggagacauacuuuugauuaauagcacagggaaucuaauugcuccucgggguuacuucaaaauacgaaauggggaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31637 - RNA, 1701 nt, Artificial Sequence
  hemagglutinin__InfluenzaA__ABG88366
augaagacuaucauugcuuugagcuacuuuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaauuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcggaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31638 - RNA, 1701 nt, Artificial Sequence
  hemagglutinin__InfluenzaA__ABG88377
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggauauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31639 - RNA, 1701 nt, Artificial Sequence; identical to SEQ ID NO: 31527
  hemagglutinin__InfluenzaA__ABG88388

SEQ ID NO: 31640 - RNA, 1701 nt, Artificial Sequence
  hemagglutinin__InfluenzaA__ABG88399
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaagcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauagguuaaucgagaaaacgaacgaaaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31641 - RNA, 1701 nt, Artificial Sequence
  hemagglutinin__InfluenzaA__ABG88410
augaagacuaucauugcuuugagcuacauuuuaugucugguuuucgcucaaaaacuucccggaaacgacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaagaugggaaaagcuaugcuugcaaaaggggaucuguuaacaguuucuuuaguagauugaauuggcugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31642 - RNA, 1701 nt, Artificial Sequence
  hemagglutinin__InfluenzaA__ABG88421
augaagacuaucauugcuuugagcuacauuuuaugucugguuuucgcucaaaaacuucccggaaaugacaacagcacagcaacgcugugccugggacaccaugcggugccaaacgggacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggauggaaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucagaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31643 - RNA, 1701 nt, Artificial Sequence
  hemagglutinin__InfluenzaA__ABG88432
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaaugcggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31644 - RNA, 1701 nt, Artificial Sequence; identical to SEQ ID NO: 31534
  hemagglutinin__InfluenzaA__ABG88443

SEQ ID NO: 31645 - RNA, 1701 nt, Artificial Sequence
  hemagglutinin__InfluenzaA__ABG88454
augaagacuaucauugcuuugagcuacauuuuaugucugguuuucgcucaaaaacuucccggaaaugacaacagcacagcaacgcugugccugggacaccaugcagugccaaacggaacgcuagugaagacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucugcuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggggagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaagugggaaaagcucaauaaugaggucagaugcauccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgguaaaacgaacgauaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagagaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31646 - RNA, 1701 nt, Artificial Sequence
  hemagglutinin__InfluenzaA__ABG88465
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauauaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31647 - RNA, 1701 nt, Artificial Sequence
  hemagglutinin__InfluenzaA__ABG88476
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcacaaauuagaauacaaauauccagcgcugaacgugacuaugccaaacaauggcaaauuugacaaauuauacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauaggaucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31648 - RNA, 1701 nt, Artificial Sequence
  hemagglutinin__InfluenzaA__ABG88487
augaagacuaucauugcuuugagcuacauuuuaugucugguuuucgcucaaaaacuucccggaaaugacaacagcacagcaacgcugugccugggacaucaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguaaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaggggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggauaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31649 - RNA, 1701 nt, Artificial Sequence
  hemagglutinin__InfluenzaA__ABG88498
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31650 - RNA, 1701 nt, Artificial Sequence
  hemagglutinin__InfluenzaA__ABG88509
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucugucaacaguuucuuuaguagauugaauuggcugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31651 - RNA, 1701 nt, Artificial Sequence
  hemagglutinin__InfluenzaA__ABG88520
augaagacuaucauugcuuugagcuacauuucaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaucgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaccaugugggccugccaaaaaggcaacauuaggugcaacauuugcauuuga

SEQ ID NO: 31652 - RNA, 1701 nt, Artificial Sequence
  hemagglutinin__InfluenzaA__ABG88531
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauuggcugcacaaauuagaauacaaauauccagcgcugaacgugacuaugccaaacaauggcaaauuugacaaauuguacauuugggggguucaccacccgagcacggacaguguccaaaccagccuauauguucgagcaucagggagagucacagucucuaccaaaagaagccaacaaacuguaaucccgaauaucggguuuagacccuggguaaggggccuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaggugucgagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31653 - RNA, 1698 nt, Artificial Sequence; identical to SEQ ID NO: 31539
  hemagglutinin__InfluenzaA__ABG88553

SEQ ID NO: 31654 - RNA, 1701 nt, Artificial Sequence
  hemagglutinin__InfluenzaA__ABG88564
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugaguugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccuccuccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcggaauguaccagagaaacaaacuagaggcauauucggcgcaaucgcggguuucauagaaaaugguugggagggaaugguagacgguugguaugguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacagacucagaaaugaacaaacuguuugaaagaacaaggaagcaacugagggaaaaugcugaggagaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31655 - RNA, 1701 nt, Artificial Sequence; identical to SEQ ID NO: 31244
  hemagglutinin__InfluenzaA__ABG88575

SEQ ID NO: 31656 - RNA, 1701 nt, Artificial Sequence; identical to SEQ ID NO: 31154
  hemagglutinin__InfluenzaA__ABG88586

SEQ ID NO: 31657 - RNA, 1701 nt, Artificial Sequence
  hemagglutinin__InfluenzaA__ABG88597
augaagacuaucauugcuuugagcuacauuuuaugucugguuuucgcucaaaaacuucccgcaaaugacaacagcacggcaacgcugugccugggacaccaugcagugccaaacggaacgcuagugaaaacaaucacgaaugacaacauugaagugacuaaugcuacugagcugguucagaguuccucaacaggcagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaacgaaagcuucaauuggacuggagucgaucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggaaaaugcaauucugaaugcaucacuccaaauggaagcauucccaaugacaaaccauuucaaaauguaaacaggaucacauauggggccugucccagguauguuaaacaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguucgaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuaa

SEQ ID NO: 31658 - RNA, 1701 nt, Artificial Sequence
  hemagglutinin__InfluenzaA__ABG88608
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcagagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaaccguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacacccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31659 - RNA, 1701 nt, Artificial Sequence; identical to SEQ ID NO: 31066
  hemagglutinin__InfluenzaA__ABG88619

SEQ ID NO: 31660 - RNA, 1701 nt, Artificial Sequence
  hemagglutinin__InfluenzaA__ABG88630
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcgacaguccucaccaaguccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguccaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaaaacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguugauugagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 31661 - RNA, 1701 nt, Artificial Sequence
  hemagglutinin__InfluenzaA__ABG88641
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggcaugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccacaucauguuuuuuacuuuguauuguuuuacugggguucaucaugugggccugccaaaaaggcaacauuaggugcaacauuugcauuuga

SEQ ID NO: 31662 - RNA, 1701 nt, Artificial Sequence; identical to SEQ ID NO: 31024
  hemagglutinin__InfluenzaA__ABG88652

SEQ ID NO: 31663 - RNA, 1701 nt, Artificial Sequence
  hemagglutinin__InfluenzaA__ABG88663
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacauuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31664 - RNA, 1701 nt, Artificial Sequence; identical to SEQ ID NO: 31517
  hemagglutinin__InfluenzaA__ABG88674

SEQ ID NO: 31665 - RNA, 1701 nt, Artificial Sequence; identical to SEQ ID NO: 31024
  hemagglutinin__InfluenzaA__ABG88685

SEQ ID NO: 31666 - RNA, 1701 nt, Artificial Sequence
  hemagglutinin__InfluenzaA__ABG88696
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaguacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugccccagauauguuaagcaaaacacucugaaguuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31667 - RNA, 1701 nt, Artificial Sequence; identical to SEQ ID NO: 30826
  hemagglutinin__InfluenzaA__ABG88707

SEQ ID NO: 31668 - RNA, 1701 nt, Artificial Sequence; identical to SEQ ID NO: 31622
  hemagglutinin__InfluenzaA__ABG88718

SEQ ID NO: 31669 - RNA, 1701 nt, Artificial Sequence
  hemagglutinin__InfluenzaA__ABG88729
augaagacuaucauugcuuugagcuacauuuuaugucugguuuucgcucaaaaacuucccggaaaugacaacagcacagcaacgcugugccugggacaucaugcagugccaaacggaacacuagugaaaacaaucacgaaugaucaaauugaagugacuaaugcuacugagcugguucagaguuccucaacagguagaauaugcgacaguccucaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaguggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuucaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaucaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31670 - RNA, 1701 nt, Artificial Sequence
  hemagglutinin__InfluenzaA__ABG88740
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguuccgaaugcaucacuccaaauggaagcauucccaaugacaaaccuuuucaaaauguaaacaggaucacauauggggccugccccagauauauuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31671 - RNA, 1701 nt, Artificial Sequence; identical to SEQ ID NO: 31559
  hemagglutinin__InfluenzaA__ABG88751

SEQ ID NO: 31672 - RNA, 1701 nt, Artificial Sequence
  hemagglutinin__InfluenzaA__ABG88762
augaagacuaucauugcuuugagcuacauuuuaugucugguuuucacucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugagaucagaugcauccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcagcagaucuuaaaagcacucaagcagcaaucgaccaaaucaacgggaaacugaauagguuaaucgagaaaacgaacgagaaauuccaucaaaucgaaaaagaagucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaaaguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31673 - RNA, 1701 nt, Artificial Sequence
  hemagglutinin__InfluenzaA__ABG88773
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucagcagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaccgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31674 - RNA, 1701 nt, Artificial Sequence
  hemagglutinin__InfluenzaA__ABG88784
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgcauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucaagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaaacaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31675 - RNA, 1701 nt, Artificial Sequence
  hemagglutinin__InfluenzaA__ABG88806
augaagacuaucauugcuuugagcuacauuuuaugccugguuuucgcucaaaaacuucccggaaaugacaacagcacggcaacgcugugccuggggcaucaugcggugccaaacggaacgcuagugaaaacaaucacgaaugaccaaauugaaguaacuaaugcuacugagcugguucagaguuccucaacagguagaauaugcgacaguccucaucaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacugugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccacgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaauuaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31676 - RNA, 1704 nt, Artificial Sequence
  hemagglutinin__InfluenzaA__ABI16504
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucaucuccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaagaucuuuugauacuguggggaauucaucauucuaauaaugcggcagagcagacaaagcucuaucaaaacccaaccaccuauauuuccguugggacaucaacacuaaaccugagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagagagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggaacuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 31677 - RNA, 1701 nt, Artificial Sequence; identical to SEQ ID NO: 31161
  hemagglutinin__InfluenzaA__ABI20793

SEQ ID NO: 31678 - RNA, 1701 nt, Artificial Sequence
  hemagglutinin__InfluenzaA__ABI20837
augaaagcaaaacuacuaguccuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggaguaacggcaucaugcucccauaaugggaaaagcaguuuuuacaaaaauuugcuauggcugacagagaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagagaccaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaaggaggguggacuggaaugauagauggaugguaugguuaucaucaucagaaugaacaaggauccggcuaugcugcggaccaaaaaagcacacaaaaugccauuaaugggauuacaaacaaagugaauucuguaaucgagaaaaugaacacucaauucacagcuguaggcaaagaauucaacaaauuagaaagaaggauggaaaacuuaaauaagaaaguugaugauggauuucuggacauuuggacauauaaugcagaauuguugguucuccuggaaaaugaaaggacuuuggauuuucaugacucaaaugugaagaaucuguaugagaaaguaaaaacccaauugaagaauaaugccaaagaaauagggaacggguguuuugaauucuaucacaaguguaacaaugaaugcauggaaagugugaaaaauggaacuuaugacuauccaaaauacuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31679 - RNA, 1701 nt, Artificial Sequence
  hemagglutinin__InfluenzaA__ABI20848
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugaaggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcccaugucucuguggugucuucgcauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguacgguuaucaucaucagaaugaacaaggaucuggauaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuuuuggauguguucuaaugggucuuugcaauguagaauaugcaucuga

SEQ ID NO: 31680 - RNA, 1701 nt, Artificial Sequence; identical to SEQ ID NO: 31425
  hemagglutinin__InfluenzaA__ABI20859

SEQ ID NO: 31681 - RNA, 1701 nt, Artificial Sequence
  hemagglutinin__InfluenzaA__ABI20870
augaaagcaaaacuacuaguccuguuaugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugucggcuaaaaggaauagccccacuacaauuggguaauugcagcguugccggauggaucuuaggaaauccagaaugcgaaucacuguuuucuaaggaaucaugguccuacauugcagaaacaccaaacccugagaauggaacauguuacccagggaauuucgcagacuaugaggaacugagagagcaauugaguucaguaucaucauucgagagauucgaaauauuccccaaagaaagcucauggcccaaccacaccguaacuaaaggaguaacgguaucaugcucccauaaugggaaaagcaguuuuuacagaaauuugcuauggcugacagagaagaauggcuuguacccaaaucugagcaaguccuauguaaacaacaaagagaaagaaguccuuguacuaugggguguucaucacccgucuaacaugagggaccaaagggccaucuaucauacagaaaaugcuuauguuucuguagugucuucacauuauagcagaagauucaccccagaaauagcaaaaagacccaaaguaagagaucaagaaggaagaauuaacuacuacuggacucugcuggaacccggggacacaauaauauuugaggcaaauggaaaucuaauagcgccaagguaugcuuucgcacugaguagaggcuuugggucaggaaucaucaccucaaacgcaucaauggaugaaugugacgcgaagugucaaacaccccaaggagcuauaaacaguagucuuccuuuccagaacguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaccaaaagagcacacaaaaugccauuaaugggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauugaagaauaaugccaaagaaauagggaacggguguuuugaauucuaucacaaguguaacaaugaaugcauggaaagugugaaaaauggaacuuaugacuauccaaaauauuccgaagaaucaaaguuaaacagggaaaagauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 31682 - RNA, 1701 nt, Artificial Sequence
  hemagglutinin__InfluenzaA__ABI20881
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccugcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaauuuaauugcuccucgggguuacuucaaaauacgaaaugggaaaagcuccauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggguacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31683 - RNA, 1701 nt, Artificial Sequence
  hemagglutinin__InfluenzaA__ABI20892
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaggaaggcuucaauuggacuggagucgcucaggaugggaaaagcuaugcuugcaaaaggggaucuguuaacaguuucuuuaguagauugaauugguugcacaaauuagaauacaaauauccagcacugaacgugacuaugccaaacaaugacaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaagggguaucuccaguagaauaagcauccauuggacaauaguaaaaccgggagacauacuuuugauuaccagcacagggaaucuaauugcuccucgggguuacuucaaaauacgaaaugggaaaagcucaauaaugaggucagaugcacccauuggcaacugcaauucugaaugcaucacuccaaauggaagcauucccaaugacaaaccuuuucaaaauguaaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaagcugaauagguuaaucgagaaaacgaacgaaaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31684 - RNA, 1701 nt, Artificial Sequence
  hemagglutinin__InfluenzaA__ABI20903
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaauuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauucauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31685 - RNA, 1701 nt, Artificial Sequence
  hemagglutinin__InfluenzaA__ABI20914
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguaaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuucgcugggguucaucaugugggccugccaaaaaggcaacauuaggugcaacauuugcauuuga

SEQ ID NO: 31686 - RNA, 1701 nt, Artificial Sequence; identical to SEQ ID NO: 31570
  hemagglutinin__InfluenzaA__ABI20925

SEQ ID NO: 31687 - RNA, 1701 nt, Artificial Sequence; identical to SEQ ID NO: 31570
  hemagglutinin__InfluenzaA__ABI20936

SEQ ID NO: 31688 - RNA, 1701 nt, Artificial Sequence
  hemagglutinin__InfluenzaA__ABI20947
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguaaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaacaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31689 - RNA, 1701 nt, Artificial Sequence
  hemagglutinin__InfluenzaA__ABI20958
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggauggaaaaagcuaugcuugcaaaaggggaucuguuaacaguuucuuuaguagauugaauugguuguacaaauuagaauacaaauauccagcgcugaacgugacuaugccaaacaauggcaaauuugacaaauuguacauaugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucagaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31690 - RNA, 1701 nt, Artificial Sequence
  hemagglutinin__InfluenzaA__ABI20969
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacgcuaauagaugcucuauugggagacccucauugugauggcuuccaaaauaaggaauggaaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31691 - RNA, 1701 nt, Artificial Sequence
  hemagglutinin__InfluenzaA__ABI20980
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccccauugugauggcuuccaaaauaaggaaugggaccuuuuuguugaacgcagcacagccuacagcaacuguuacccuuaugaugugccggauuaugccucccuuaggucacuaguugccucauccggcacacuugaguuuaacaaugaaagcuucaauuggacuggagucgaucagaauggaacaagcucugcuugcaaaaggagaucuacuaaaaguuucuuuaguagauugaauugguugcaccaauuaaaauacaaauauccagcacugaacgugacuaugccaaacaaugaaaaauuugacaaauuguacauuugggggguucaccauccgaguacggacagugaccaaaucagccuauaugcucaagcaucagggagagucacagucucuaccaaaagaagccaacaaacuguaaccccgaauaucggaucuagacccuggguaaggggugucuccagcagaauaagcauuuauuggacaauaguaaaaccgggagacauacuuuugauuaacagcacagggaaucuaauugcuccucgggguuacuucaaaauacgaagugggaaaagcucaauaaugaggucaaaugcacucauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagauucuuguugcccuggagaaccaacauacaauugaucuaacugacucagaaaugaacaaacuguucgaaagaacaaggaaacaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31692 - RNA, 1701 nt, Artificial Sequence
  hemagglutinin__InfluenzaA__ABI20991
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaauaaacaaacuauuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31693 - RNA, 1701 nt, Artificial Sequence
  hemagglutinin__InfluenzaA__ABI21002
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugaguugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcggaauguaccagagaaacaaacuagaggcauauucggcgcaaucgcggguuucauagaaaaugguugggagggaaugguagacgguugguaugguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaucaacauacaauugaucuaacagacucagaaaugaacaaacuguuugaaagaacaaggaagcaacugagggaaaaugcugaggagaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31694 - RNA, 1701 nt, Artificial Sequence; identical to SEQ ID NO: 31658
  hemagglutinin__InfluenzaA__ABI21013

SEQ ID NO: 31695 - RNA, 1701 nt, Artificial Sequence
  hemagglutinin__InfluenzaA__ABI21024
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguaaauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucucaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31696 - RNA, 1701 nt, Artificial Sequence; identical to SEQ ID NO: 31074
  hemagglutinin__InfluenzaA__ABI21035

SEQ ID NO: 31697 - RNA, 1701 nt, Artificial Sequence
  hemagglutinin__InfluenzaA__ABI21046
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauuccaaaugacaaaccauuucaaaauguaaacaggaucacauauggggccugccccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31698 - RNA, 1701 nt, Artificial Sequence
  hemagglutinin__InfluenzaA__ABI21057
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31699 - RNA, 1701 nt, Artificial Sequence
  hemagglutinin__InfluenzaA__ABI21068
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 31700 - RNA, 1701 nt, Artificial Sequence; identical to SEQ ID NO: 30826
  hemagglutinin__InfluenzaA__ABI21079

SEQ ID NO: 31701 - RNA, 1701 nt, Artificial Sequence
  hemagglutinin__InfluenzaA__ABI21090
augaagacuaucauugcuuugagcuacauucuaugucugguuuucgcucaaaaacuucccggaaaugacaacagcacggcaacgcugugccuugggcaccaugcaguaccaaacggaacgguagugaaaacaaucacaaaugaccaaauugaaguuacuaaugcuacugagcugguucagaguuccucaacagguggaauaugcgacaguccucaucagauccuugauggagaaaacugcacacuaauggaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaaaaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31702 - RNA, 1701 nt, Artificial Sequence; identical to SEQ ID NO: 31701
  hemagglutinin__InfluenzaA__ABI21101

SEQ ID NO: 31703 - RNA, 1701 nt, Artificial Sequence
  hemagglutinin__InfluenzaA__ABI21123
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaacacguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31704 - RNA, 1701 nt, Artificial Sequence
  hemagglutinin__InfluenzaA__ABI21134
augaagacuaucauugcuuugagcuacauucuaugucugguuuucgcucaaaaacuucccggaaaugacaacagcacggcaacgcugugccuugggcaccaugcaguaccaaacggaacgguagugaaaacaaucacaaaugaccaaauugaaguuacuaaugcuacugagcugguucagaguuccucaacagguggaauaugcgacaguccucaucagauccuugauggagaaaacugcacacuaauggaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagauccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaaaaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31705 - RNA, 1701 nt, Artificial Sequence; identical to SEQ ID NO: 30826
  hemagglutinin__InfluenzaA__ABI21156

SEQ ID NO: 31706 - RNA, 1701 nt, Artificial Sequence
  hemagglutinin__InfluenzaA__ABI21167
augaagacuaucauugcuuugggcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugaaguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31707 - RNA, 1701 nt, Artificial Sequence
  hemagglutinin__InfluenzaA__ABI21178
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcagcuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31708 - RNA, 1698 nt, Artificial Sequence
  hemagglutinin__InfluenzaA__ABI21200
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacaggaauuugcuauggcugacggggaagaaugguuuguauccaaaccugagcaaguccuaugcaaacaacaaagagaaagagguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31709 - RNA, 1698 nt, Artificial Sequence
  hemagglutinin__InfluenzaA__ABI21211
augaaaguuaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaagagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuacagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagcuauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31710 - RNA, 1698 nt, Artificial Sequence
  hemagglutinin__InfluenzaA__ABI21233
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaauucaguaucuucauuugagagguucgaaauauuccccaaagagagcucauggcccaaccacaccguaaccggaguaucagcaucaugcucccauaacgggaaaagcaguuuuuacaggaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31711 - RNA, 1701 nt, Artificial Sequence
  hemagglutinin__InfluenzaA__ABI21244
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccugaaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaagugggaaaagcucaauaaugaggucagaugcacccauuggcaacugcaguuccgaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuaggguucaucaugugggccugccaaaaaggcaacauuaggugcaacauuugcauuuga

SEQ ID NO: 31712 - RNA, 1701 nt, Artificial Sequence
  hemagglutinin__InfluenzaA__ABI21255
augaagacuaucauugcuuugagcuacauuuuaugucugguuuucgcucaaaaacuucccggaaaugacaacagcacagcaacgcugugccuaggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguuccgaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31713 - RNA, 1701 nt, Artificial Sequence; identical to SEQ ID NO: 31559
  hemagglutinin__InfluenzaA__ABI21266

SEQ ID NO: 31714 - RNA, 1701 nt, Artificial Sequence; identical to SEQ ID NO: 31559
  hemagglutinin__InfluenzaA__ABI21277

SEQ ID NO: 31715 - RNA, 1701 nt, Artificial Sequence
  hemagglutinin__InfluenzaA__ABI21299
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaaugacaaauuugacaaauuguacauuugggggguucaccacccgagcacggacagugaccaaaccagccuauauguucgagcaucagggagagucacagucucuaccaaaagaagucaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagagaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31716 - RNA, 1701 nt, Artificial Sequence; identical to SEQ ID NO: 31557
  hemagglutinin__InfluenzaA__ABI21310

SEQ ID NO: 31717 - RNA, 1701 nt, Artificial Sequence
  hemagglutinin__InfluenzaA__ABI21321
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31718 - RNA, 1701 nt, Artificial Sequence
  hemagglutinin__InfluenzaA__ABI21332
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucaagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcguuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31719 - RNA, 1701 nt, Artificial Sequence
  hemagglutinin__InfluenzaA__ABI21343
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaguacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguuccgaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31720 - RNA, 1701 nt, Artificial Sequence
  hemagglutinin__InfluenzaA__ABI21354
augaagacuaucauugcuuugagcuacauuucaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31721 - RNA, 1701 nt, Artificial Sequence
  hemagglutinin__InfluenzaA__ABI21365
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaauggacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31722 - RNA, 1701 nt, Artificial Sequence
  hemagglutinin__InfluenzaA__ABI21376
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuauucuugcaaaaggggaucuguuaacaguuucuuuaguagauugaauugguugcacaaauuagaauacaaauauccagcgcugaacgugacuaugccaaacaaugacaaauuugacaaauuguacauuugggggguucaccacccgagcacggacagugaccaaaccagccuauauguucgagcaucagggagagucacagucucuaccaaaagaagucaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagagaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuaa

SEQ ID NO: 31723 - RNA, 1701 nt, Artificial Sequence; identical to SEQ ID NO: 31557
  hemagglutinin__InfluenzaA__ABI21387

SEQ ID NO: 31724 - RNA, 1701 nt, Artificial Sequence
  hemagglutinin__InfluenzaA__ABI21398
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuugucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguuccgaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31725 - RNA, 1701 nt, Artificial Sequence
  hemagglutinin__InfluenzaA__ABI21409
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuguugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31726 - RNA, 1701 nt, Artificial Sequence
  hemagglutinin__InfluenzaA__ABI21420
augaagacuaucauugcuuugagcuacauuuuaugucugguuuucacucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuauucuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugagaucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugauaaugccugcauagggucaaucagaaauggaacuuaugaccaugauguauacagagacgaagcauuaaacaaccgguuccagaucaaaaguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31727 - RNA, 1701 nt, Artificial Sequence; identical to SEQ ID NO: 31557
  hemagglutinin__InfluenzaA__ABI21431

SEQ ID NO: 31728 - RNA, 1701 nt, Artificial Sequence; identical to SEQ ID NO: 31559
  hemagglutinin__InfluenzaA__ABI21442

SEQ ID NO: 31729 - RNA, 1701 nt, Artificial Sequence; identical to SEQ ID NO: 31559
  hemagglutinin__InfluenzaA__ABI21453

SEQ ID NO: 31730 - RNA, 1701 nt, Artificial Sequence; identical to SEQ ID NO: 31725
  hemagglutinin__InfluenzaA__ABI21464

SEQ ID NO: 31731 - RNA, 1701 nt, Artificial Sequence; identical to SEQ ID NO: 31559
  hemagglutinin__InfluenzaA__ABI21475

SEQ ID NO: 31732 - RNA, 1701 nt, Artificial Sequence
  hemagglutinin__InfluenzaA__ABI21486
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguuccgaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagaagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31733 - RNA, 1701 nt, Artificial Sequence; identical to SEQ ID NO: 31559
  hemagglutinin__InfluenzaA__ABI21497

SEQ ID NO: 31734 - RNA, 1698 nt, Artificial Sequence
  hemagglutinin__InfluenzaA__ABI21530
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucuucauuugagagguucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaucugagcaaguccuauguaaacaacaaggagaaagaaguccuuguacuaugggguguucaucacccgucuaacauagggguccaaagggccaucuaucguacagaaaaugcuuaugucucuguagugucuucacauuauagcagaagauucaccccagaaauagcaaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuugagucaggaaucaucaccucaaaugcaccaaugaaugaaugugaugcaaagugucaaacaccucagggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuagucucccugggggcaaucagcuucuggauguguuccaaugggucuuugcaguguagaauaugcaucuga

SEQ ID NO: 31735 - RNA, 1698 nt, Artificial Sequence
  hemagglutinin__InfluenzaA__ABI21552
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucuucauuugagagguucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaucugagcaaguccuauguaaacaacaaggagaaagaaguccuuguacuaugggguguucaucacccgucuaacauagggguccaaagggccaucuaucauacagaaaaugcuuaugucucuguagugucuucacauuauagcagaagauucaccccagaaauagcaaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuugagucaggaaucaucaccucaaaugcaccaauggaugaaugugaugcaaagugucaaacaccucagggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuagucucccugggggcaaucagcuucuggauguguuccaaugggucuuugcaguguagaauaugcaucuga

SEQ ID NO: 31736 - RNA, 1698 nt, Artificial Sequence
  hemagglutinin__InfluenzaA__ABI21563
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucuucauuugagagguucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaucugagcaaguccuauguaaacaacaaggagaaagaaguccuuguacuaugggguguucaucacccgucuaacauagggguccaaagggccaucuaucauacagaaaaugcuuaugucucuguagugucuucacauuauagcagaagauucaccccagaaauagcaaaaagacccaaaguaagaggucaggaaggaagaaucaacuacuacuggacucugcuggaacccggggacacaauaauauuugaggcaaauggaaaucuaauagcgccaugguaugcuuucgcacugaguagaggcuuugagucaggaaucaucaccucaaaugcaccaaugaaugaaugugaugcaaagugucaaacaccucagggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuagucucccugggggcaaucagcuucuggauguguuccaaugggucuuugcaguguagaauaugcaucuga

SEQ ID NO: 31737 - RNA, 1698 nt, Artificial Sequence
  hemagglutinin__InfluenzaA__ABI21574
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucuucauuugagagguucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaucugagcaaguccuauguaaacaacaaagagaaagaaguccuuguacuaugggguguucaucacccgucuaacauagggguccaaagggccaucuaucauacagaaaaugcuuaugucucuguagugucuucacauuauagcagaagauucaccccagaaauagcaaaaagacccaaaguaagaggucaggaaggaagaaucaacuacuacuggacucugcuggaacccggggacacaauaauauuugaggcaaauggaaaucuaauagcgccaugguaugcuuucgcacugaguagaggcuuugagucaggaaucaucaccucaaaugcaccaaugaaugaaugugaugcaaagugucaaacaccucagggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuagucucccugggggcaaucagcuucuggauguguuccaaugggucuuugcaguguagaauaugcaucuga

SEQ ID NO: 31738 - RNA, 1701 nt, Artificial Sequence
  hemagglutinin__InfluenzaA__ABI21736
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaagccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuauuugaaagaacaaagaagcaacugagggaaaaugcugaggaugugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31739 - RNA, 1701 nt, Artificial Sequence
  hemagglutinin__InfluenzaA__ABI22159
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaacgccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31740 - RNA, 1707 nt, Artificial Sequence
  hemagglutinin__InfluenzaA__ABI23979
auggagaaaauaguacuucuucuugcaauaaucagucuuguuaaaagugaucagauuugcauugguuaccaugcaaacaacucgacagagcagguugacacaauaauggaaaagaacgucacuguuacacacgcccaagacauacuggaaaagacacacaacgggaagcucugcgaucuagacggagugaagccucuaauuuuaagagauuguaguguagcuggauggcuccucgggaauccaaugugugacgaauuccucaaugugccggaauggucuuacauaguggagaagaucaauccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaagguccuccuuuuuuagaaaugugguauggcuuaucaaaaaggacaaugcauacccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagauugguaccaaaaauagcuacuagauccaagguaaacgggcaaaguggaaggauggaguucuuuuggacaauuuuaaaaccgaaugaugcaauaaauuuugagaguaauggaaauuucauugcuccagaaaaugcauacaaaauugucaagaaaggggacucaacaaucaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaagaaaaaagagaggacuauuuggagcuauagcagguuuuauagagggaggauggcagggaaugguagaugguugguauggguaccaccauagcaacgagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaagauggaagacggauuucuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaaucaagauuaaaaagagaggaaauaaguggaguaaaauuggaaucaauaggaacuuaucaaauacugucaauuuauucaacaguggcgagcucccuagcacuggcaaucaugguggcuggucuaucuuuauggaugugcuccaauggaucguuacaaugcagaauuugcauuuaa

SEQ ID NO: 31741 - RNA, 1701 nt, Artificial Sequence; identical to SEQ ID NO: 30826
  hemagglutinin__InfluenzaA__ABI26646

SEQ ID NO: 31742 - RNA, 1701 nt, Artificial Sequence
  hemagglutinin__InfluenzaA__ABI30367
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucacauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauaguagaagauucaccccagaaauaacaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaccaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggguuucuggacauuuggacauauaaugcagaguuguugguucuccuggaaaaugaaaggacuuuggauuuucaugacucaaaugugaagaaucuguaugagaaaguaaaaacccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31743 - RNA, 1701 nt, Artificial Sequence
  hemagglutinin__InfluenzaA__ABI30378
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaccacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggguuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31744 - RNA, 1701 nt, Artificial Sequence
  hemagglutinin__InfluenzaA__ABI30400
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggauucaucaugugggccugccaaaaaggcaacauuaggugcaacauuugcauuuga

SEQ ID NO: 31745 - RNA, 1701 nt, Artificial Sequence
  hemagglutinin__InfluenzaA__ABI30411
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaaugcggagcuucuuguugcccuggagaaccagcauacaauugaucuaacugacucagaaauggacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31746 - RNA, 1701 nt, Artificial Sequence; identical to SEQ ID NO: 31095
  hemagglutinin__InfluenzaA__ABI30422

SEQ ID NO: 31747 - RNA, 1701 nt, Artificial Sequence; identical to SEQ ID NO: 30826
  hemagglutinin__InfluenzaA__ABI30433

SEQ ID NO: 31748 - RNA, 1701 nt, Artificial Sequence; identical to SEQ ID NO: 31095
  hemagglutinin__InfluenzaA__ABI30444

SEQ ID NO: 31749 - RNA, 1701 nt, Artificial Sequence; identical to SEQ ID NO: 30826
  hemagglutinin__InfluenzaA__ABI30455

SEQ ID NO: 31750 - RNA, 1701 nt, Artificial Sequence; identical to SEQ ID NO: 30826
  hemagglutinin__InfluenzaA__ABI30466

SEQ ID NO: 31751 - RNA, 1701 nt, Artificial Sequence; identical to SEQ ID NO: 30826
  hemagglutinin__InfluenzaA__ABI30477

SEQ ID NO: 31752 - RNA, 1701 nt, Artificial Sequence
  hemagglutinin__InfluenzaA__ABI30488
augaagacuaucauugcuuugagcuacauucuaugucugguuuucgcucaaaaacuucccggaaaugacaacagcacggcaacgcugugccuugggcaccaugcaguaccaaacggaacgauaguaaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31753 - RNA, 1701 nt, Artificial Sequence; identical to SEQ ID NO: 30826
  hemagglutinin__InfluenzaA__ABI30499

SEQ ID NO: 31754 - RNA, 1701 nt, Artificial Sequence
  hemagglutinin__InfluenzaA__ABI30510
augaagacuaucauugcuuugagcuacauucuaugucugguuuucgcucaaaaacuucccggaaaugacaacagcacggcaacgcugugccuugggcaccaugcaguaccaaacgggacgauagugaaaacaaucacgaaugaccaaauugaagucacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31755 - RNA, 1701 nt, Artificial Sequence
  hemagglutinin__InfluenzaA__ABI30521
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31756 - RNA, 1701 nt, Artificial Sequence; identical to SEQ ID NO: 30824
  hemagglutinin__InfluenzaA__ABI30532

SEQ ID NO: 31757 - RNA, 1701 nt, Artificial Sequence; identical to SEQ ID NO: 31701
  hemagglutinin__InfluenzaA__ABI30543

SEQ ID NO: 31758 - RNA, 1701 nt, Artificial Sequence; identical to SEQ ID NO: 30824
  hemagglutinin__InfluenzaA__ABI30554

SEQ ID NO: 31759 - RNA, 1698 nt, Artificial Sequence
  hemagglutinin__InfluenzaA__ABI30565
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacaggaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31760 - RNA, 1701 nt, Artificial Sequence; identical to SEQ ID NO: 31161
  hemagglutinin__InfluenzaA__ABI30587

SEQ ID NO: 31761 - RNA, 1701 nt, Artificial Sequence
  hemagglutinin__InfluenzaA__ABI30609
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucaugaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccaguagaauaagcauauauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31762 - RNA, 1701 nt, Artificial Sequence
  hemagglutinin__InfluenzaA__ABI30620
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaaggaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccguuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaguagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31763 - RNA, 1701 nt, Artificial Sequence; identical to SEQ ID NO: 31137
  hemagglutinin__InfluenzaA__ABI30733

SEQ ID NO: 31764 - RNA, 1701 nt, Artificial Sequence
  hemagglutinin__InfluenzaA__ABI30744
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagugucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgaaaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauucuauggauuuccuuugccauaucauguuuuuugcuuuguguugcuuuguugggguucaucaugugggccugccaaaaaggcaacauuaggugcaacauuugcauuuga

SEQ ID NO: 31765 - RNA, 1701 nt, Artificial Sequence; identical to SEQ ID NO: 31764
  hemagglutinin__InfluenzaA__ABI30755

SEQ ID NO: 31766 - RNA, 1701 nt, Artificial Sequence; identical to SEQ ID NO: 31161
  hemagglutinin__InfluenzaA__ABI30766

SEQ ID NO: 31767 - RNA, 1701 nt, Artificial Sequence
  hemagglutinin__InfluenzaA__ABI30777
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaguugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31768 - RNA, 1701 nt, Artificial Sequence
  hemagglutinin__InfluenzaA__ABI30788
augaagacuaucauugcuuugagcuacauucuaugucugguuuucgcucaaaaacuuuccggaaaugacaacagcacggcaacacugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31769 - RNA, 1701 nt, Artificial Sequence; identical to SEQ ID NO: 31137
  hemagglutinin__InfluenzaA__ABI30799

SEQ ID NO: 31770 - RNA, 1701 nt, Artificial Sequence
  hemagglutinin__InfluenzaA__ABI30810
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucaaaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31771 - RNA, 1701 nt, Artificial Sequence
  hemagglutinin__InfluenzaA__ABI30821
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacguggcuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31772 - RNA, 1701 nt, Artificial Sequence; identical to SEQ ID NO: 31137
  hemagglutinin__InfluenzaA__ABI30832

SEQ ID NO: 31773 - RNA, 1701 nt, Artificial Sequence
  hemagglutinin__InfluenzaA__ABI30843
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccuaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugauuuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31774 - RNA, 1701 nt, Artificial Sequence
  hemagglutinin__InfluenzaA__ABI30865
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucauuaugugggccugccaaaaaggcaacauuaggugcaacauuugcauuuga

SEQ ID NO: 31775 - RNA, 1707 nt, Artificial Sequence
  hemagglutinin__InfluenzaA__ABI36155
auggagaaaauagugcuucuucuugcaacagucagucuuguuaaaagugaucagauuugcauugguuaccaugcaaacaauucaacagagcagguugacacaauaauggaaaagaacgucacugucacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccagccaauggccucuguuacccagggaauuucaacgacuaugaagaacugaaacaccuauugagcagaauaaaucauuuugaaaaacuucagauaauccccaaaaguucuugguccgaucaugaagccucauuaggggugagcucagcauguccauaccugggaagguccuccuucuuuagaaaugugguauggcuuaucaaaaagaacaauacauacccaacaauaaagagaagcuacaauaauaccaaccaagaagaucuuuugguacugugggggauucaccauccuaaugaugcagcagagcagacaaggcuauaucaaaacccaaccacuuauauuuccguugggacaucaacacuaaaccagagauugguaccaaaaauagcuacuagauccaaaguaaaugggcaaaguggaaggauggaauucuucuggacaauuuuaaaaccgaaugaugcaaucaacuucgagaguaauggaaauuucauugcuccagaauaugcauacaaaauuguaaagaaaggggacucugcaauuaugaaaagugaauuggaauauggugacugcaacaccaagugucaaacuccaaugggggcgauaaacucuaguaugccacuccacaacauacacccucucaccaucggggaaugccccaaauaugugaagucaaacagauuaguccuugcgacugggcucagaaauagcccucaaagagagagaagaagaaaaaagagaggacuauuuggagcuauagcagguuuuauagaagggggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaaccuagaaaggagaauagagaauuuaaacaagaaaauggaagauggauuccuagaugucuggacuuauaaugcugaacuacugguucucauggaaaaugagagaacuuuggacuuucaugauucaaauguuaagaaccucuaugacaagguccgauuacagcuuagggauaaugcaaaggagcugggcaaugguuguuucgaguucuaucacaaaugugauaaugaauguauggaaaguauaagaaacggaacguauaacuacccgcaguauucagaagaagcaagauuaaaaagagaggaaauaagcggaguaaaacuggaaucaauaggaauuuaccaaauacugucaauuuauucaacaguggcgaguucccuagcacuggcaaucaugauggcuggucuaucuuuauggaugugcuccaauggaucguuacaaugcagaguuugcauuuaa

SEQ ID NO: 31776 - RNA, 1707 nt, Artificial Sequence
  hemagglutinin__InfluenzaA__ABI36166
auggagaaaauagugcuucuucuugcaacagucagucuuguuaaaagugaucagauuugcauugguuaccaugcaaacaauucaacagagcagguugacacaauaauggaaaagaacgucacugucacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccagccaauggccucuguuacccagggaauuucaacgacuaugaagaacugaaacaccuauugagcagaauaaaucauuuugaaaaacuucagauaauccccaaaaguucuugguccgaucaugaagccucauuaggggugagcucagcauguccauaccugggaagguccuccuucuuuagaaaugugguauggcuuaucaaaaagaacaauacauacccaacaauaaagagaagcuacaauaauaccaaccaagaagaucuuuugguacugugggggauucaccauccuaaugaugcagcagagcagacaaggcuauaucaaaacccaaccacuuauauuuccguugggacaucaacacuaaaccagagauugguaccaaaaauagcuacuagauccaaaguaaaugggcaaaguggaaggauggaauucuucuggacaauuuuaaaaccgaaugaugcaaucaacuucgagaguaauggaaauuucauugcuccagaauaugcauacaaaauuguaaagaaaggggacucugcaauuaugaaaagugaauuggaauauggugacugcaacaccaagugucaaacuccaaugggggcgauaaacucuaguaugccauuccacaacauacacccucucaccaucggggaaugccccaaauaugugaagucaaacagauuaguccuugcgacugggcucagaaauagcccucaaagagagagaagaagaaaaaagagaggacuauuuggagcuauagcagguuuuauagaagggggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaaccuagaaaggagaauagagaauuuaaacaagaaaauggaagauggauuccuagaugucuggacuuauaaugcugaacuacugguucucauggaaaaugagagaacuuuggacuuucaugauucaaauguuaagaaccucuaugacaagguccgauuacagcuuagggauaaugcaaaggagcugggcaaugguuguuucgaguucuaucacaaaugugauaaugaauguauggaaaguauaagaaacggaacguauaacuacccgcaguauucagaagaagcaagauuaaaaagagaggaaauaagcggaguaaaacuggaaucaauaggaauuuaccaaauacugucaauuuauucaacaguggcgaguucccuagcacuggcaaucaugauggcuggucuaucuuuauggaugugcuccaauggaucguuacaaugcagaguuugcauuuaa

SEQ ID NO: 31777 - RNA, 1707 nt, Artificial Sequence; identical to SEQ ID NO: 31776
  hemagglutinin__InfluenzaA__ABI36177

SEQ ID NO: 31778 - RNA, 1707 nt, Artificial Sequence
  hemagglutinin__InfluenzaA__ABI36406
auggagaaaauagugcuucuucuugcaacagucagucuuguuaaaagugaucagauuugcauugguuaccaugcaaacaauucaacagagcagguugacacaauaauggaaaagaacgucacugucacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccagccaauggccucuguuacccagggaauuucaacgacuaugaagaacugaaacaccuauugagcagaauaaaucauuuugaaaaacuucagauaauccccaaaaguucuugguccgaucaugaagccucauuaggggugagcucagcauguccauaccugggaagguccuccuucuuuagaaaugugguauggcuuaucaaaaagaacaauacauacccaacaauaaagagaagcuacaauaauaccaaccaagaagaucuuuugguacugugggggcuucaccauccuaaugaugcagcagagcagacaaggcuauaucaaaacccaaccacuuauauuuccguugggacaucaacacuaaaccagagauugguaccaaaaauagcuacuagauccaaaguaaaugggcaaaguggaaggauggaauucuucuggacaauuuuaaaaccgaaugaugcaaucaacuucgagaguaauggaaauuucauugcuccagaauaugcauacaaaauuguaaagaaaggggacucugcaauuaugaaaagugaauuggaauauggugacugcaacaccaagugucaaacuccaaugggggcgauaaacucuaguaugccauuccacaacauacacccucucaccaucggggaaugccccaaauaugugaagucaaacagauuaguccuugcgacugggcucagaaauagcccucaaagagagagaagaagaaaaaagagaggacuauuuggagcuauagcagguuuuauagaagggggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaaccuagaaaggagaauagagaauuuaaacaagaaaauggaagauggauuccuagaugucuggacuuauaaugcugaacuacugguucucauggaaaaugagagaacuuuggacuuucaugauucaaauguuaagaaccucuaugacaagguccgauuacagcuuagggauaaugcaaaggagcugggcaaugguuguuucgaguucuaucacaaaugugauaaugaauguauggaaaguauaagaaacggaacguauaacuacccgcaguauucagaagaagcaagauuaaaaagagaggaaauaagcggaguaaaacuggaaucaauaggaauuuaccaaauacugucaauuuauucaacaguggcgaguucccuagcacuggcaaucaugauggcuggucuaucuuuauggaugugcuccaauggaucguuacaaugcagaguuugcauuuaa

SEQ ID NO: 31779 - RNA, 1707 nt, Artificial Sequence
  hemagglutinin__InfluenzaA__ABI36450
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacugggaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaccuauugagcagaauaaaccauuuugagaaaauucaaaucauccccaaaaguucuugguccgaucaugaagccucaucaggagugagcucagcauguccauaccugggaaguccuuccuuuuuuagaaaugugguauggcuuaucaaaaagaacaguacauacccaacaauaaagacaagcuacaauaauaccaaccaagaagaucuuuugguacuguggggaauucaccauucuaaugaugcggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcaauaaacucuaguaugccauuccacaacauacacccucucaccaucggggaaugccccaaauaugugaaaucaaacagauuaguccuugcaacagggcucagaaauagcccucaaagagagagcagaagaaaaaagagaggucuauuuggagcuauagcaggcuuuauagagggaggauggcagggaaugguagaugguugguauggguaccaccauagcaaugagcaggggaguggguacgcugcagacaaagaauccacucaaaaggcaauagauggagucaccaauaaggucaacucaauuauugacaaaaugaacacucaguuugaggccguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucgaauguuaagaaccucuacgacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguggcgaguucccuagcacuggcaaucaugauagcuggucuaucuuuauggaugugcuccaauggaucguuacaaugcagaauuugcauuuaa

SEQ ID NO: 31780 - RNA, 1707 nt, Artificial Sequence
  hemagglutinin__InfluenzaA__ABI49396
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacugggaaaaacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaucuauugagcagaauaaaccauuuugagaaaauucaaaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaaugaugcggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucugggcaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccacaaagagagagcagaagaaaaaagagaggacuauuuggagcuauagcagguuuuauagagggaggauggcagggaaugguagauggcugguauggguaccaccauagcaaugagcaggggaguggguacgcugcagacaaagaauccacucaaaaggcaauagauggagucaccaauaaggucaacucaauuauugacaaaaugaacacucaguuugaggcuguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuacgacaagguccgacuacagcuuagggauaaugcaaaagagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguagcgaguucccuagcacuggcaaucaugauagcuggucuaucuuuauggaugugcuccaauggaucguuacaaugcagaauuugcauuuaa

SEQ ID NO: 31781 - RNA, 1704 nt, Artificial Sequence
  hemagglutinin__InfluenzaA__ABI85000
augaauacucaaauuuuggcauucauugcuuguaugcugauuggaacuaaaggagacaaaauaugucuugggcaccaugcuguggcaaaugggacaaaagugaacacacuaacagagaggggaauugaaguagucaaugccacggagacgguggaaacuguaaauauuaagaaaauaugcacucaaggaaaaaggccaacagaucugggacaauguggacuucuaggaacccuaauaggaccuccccaaugcgaucaauuucuggaguuugacgcuaauuugauaauugaacgaagagaaggaaccgaugugugcuaucccgggaaguucacaaaugaagaaucacugaggcagauccuucgagggucaggaggaauugauaaagagucaauggguuucaccuauaguggaauaagaaccaauggggcgacgagugccugcagaagaucagguucuucuuucuaugcggagaugaaaugguuacugucgaauucagacaaugcggcauuuccccaaaugacuaagucguauaggaaucccaggaacaaaccagcucugauaaucuggggagugcaucacucuggaucagcuacugagcagaccaaacucuauggaaguggaaacaaguugauaacaguaggaagcucgaaauaccagcaaucauucacuccaaguccgggagcacggccacaagugaauggacaaucaggaaggauugauuuucauuggcuacuccuugaccccaaugacacagugaccuucacuuucaauggggcauucauagccccugacagggcaaguuucuuuagaggagaaucgcuaggaguccagagugauguuccuuuggauucugguugugaaggggauugcuuccacaguggggguacgauagucaguucccugccauuccaaaacaucaacccuagaacaguggggaaaugcccucgauaugucaaacagacaagccuccuuuuggcuacaggaaugagaaacgucccagagaaccccaagcaggccuaccagaaacggaugaccagaggccuuuuuggagcgauugcuggauucauagagaauggaugggaaggucucaucgauggaugguaugguuucagacaucaaaaugcacaaggagaaggaacugcagcugacuacaaaagcacccaaucugcaauagaucagaucacaggcaaauugaaucgucugauugacaaaacaaaccagcaguuugaacugauagacaaugaauucagugagauagaacaacaaaucgggaaugucauuaacuggacacgagacucaaugacugagguauggucguauaaugcugagcuguugguggcaauggagaaucagcauacaauagaucuugcagacucagaaaugaacaaacuuuacgaacgcgucagaaaacaacuaagggaaaaugcugaagaagauggaacuggaugcuuugagauauuccauaagugugaugaucaguguauggagagcauaaggaacaacacuuaugaccauacccaauacaggacagagucauugcagaauagaauacagauagacccagugaaauugaguaguggauacaaagacauaaucuuaugguuuagcuucggggcaucauguuuucuucuucuagccauugcaaugggauugguuuucauuugcauaaagaauggaaacaugcggugcacuauuuguauauag

SEQ ID NO: 31782 - RNA, 1701 nt, Artificial Sequence
  hemagglutinin__InfluenzaA__ABI92291
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaauuccucaacagguaggauaugugacaguccucaccgaauccuugaugggaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugauaaauuugacaaauuguacauuugggggguucaccacccgaguacggacagugaccaaaccagccuauauguucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcggaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucagaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31783 - RNA, 1701 nt, Artificial Sequence
  hemagglutinin__InfluenzaA__ABI92302
augaaagcaaaacugcugguccuguuaugugcacuuucagcuacagaugcagacacaauauguauaggcuaccaugcgaacaacucaaccgauacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugugaaucacuguuuucuaagaaaucaugguccuacauugcagaaacaccaaacuccgagaaugggacauguuacccaggguauuucgccgacuaugaggaacugagggagcaauugaguucaguaucaucauucgagagauucgaaauauuccccaaggaaaguucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacagaagauucaccccagaaauagcaaaacgacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaauacgucaggaguacaaaauuaaggauggucacaggacuaaggaacauuccauccauucaauccagagguuuguuuggagccauugcugguuucauugaagggggauggacuggaaugauagauggaugguaugguuaucaucaucagaaugaacagggauccggcuaugcugcagaucaaaaaagcacacaaaaugccauuaacgggauuacaaacaaggugaacucuguuaucgagaaaaugaacauucaauucacagcuguagguaaagaauucaacaaauuagaaaaaaggauggaaaacuuaaauaaaaagguugaugauggguuucuggacauuuggacauauaaugcagaauuguugguucuacuggaaaaugaaaggacuuuggauuuucaugacucaaaugugaagaaccuguaugagaagguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31784 - RNA, 1701 nt, Artificial Sequence
  hemagglutinin__InfluenzaA__ABI92313
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaauaucaucauucgagagauucgaaauauuccccaaggaaagcucauggcccaaccacaccguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauaacaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggagucuaucauauucuggcgaucuacucaacugucgccaguucacuggugcuuuuggucucccugggggcaaucaguuucuggauguguucuaaugggucuuugcaguguagaauaugcaucuga

SEQ ID NO: 31785 - RNA, 1701 nt, Artificial Sequence
  hemagglutinin__InfluenzaA__ABI92324
augaagacuaucauugcuuugagcuacauuuuaugucugguuuucgcucaaaaacuucccggaaaugacaacagcacagcaacgcuaugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggaaagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31786 - RNA, 1701 nt, Artificial Sequence
  hemagglutinin__InfluenzaA__ABI92335
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacaaguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauggggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugaugggguucaucaugugggccugccaaaaaggcaacauuaggugcaacauuugcauuuga

SEQ ID NO: 31787 - RNA, 1701 nt, Artificial Sequence
  hemagglutinin__InfluenzaA__ABI92346
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggcaugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccauaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31788 - RNA, 1701 nt, Artificial Sequence
  hemagglutinin__InfluenzaA__ABI92357
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaccucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31789 - RNA, 1701 nt, Artificial Sequence; identical to SEQ ID NO: 30826
  hemagglutinin__InfluenzaA__ABI92368

SEQ ID NO: 31790 - RNA, 1698 nt, Artificial Sequence
  hemagglutinin__InfluenzaA__ABI92379
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacaggaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuacagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31791 - RNA, 1701 nt, Artificial Sequence
  hemagglutinin__InfluenzaA__ABI92390
augaagacuaucauugcuuuuagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaccagccuauaugcucaagcaucaggaagaaucacagucucuaccaaaagaagccaacaaacuguaaccccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacccugaaauuggcaacagggaugcgaaauguaccagagaaacaaaccagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaaguugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagggaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacaucugcauuuga

SEQ ID NO: 31792 - RNA, 1701 nt, Artificial Sequence
  hemagglutinin__InfluenzaA__ABI92401
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaagggcaacauuaggugcaacauuugcauuuga

SEQ ID NO: 31793 - RNA, 1701 nt, Artificial Sequence
  hemagglutinin__InfluenzaA__ABI92412
augaagacuaucauugcuuugagcuacauucuaugucugguuuucgcucaaaaacuucccggaaaugacaacagcacggcaacgcugugccuugggcaccaugcaguaccaaacggaacgcuagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauauaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31794 - RNA, 1701 nt, Artificial Sequence
  hemagglutinin__InfluenzaA__ABI92423
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagauaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31795 - RNA, 1701 nt, Artificial Sequence
  hemagglutinin__InfluenzaA__ABI92434
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugauguuccggauuaugccucccuuaggucacuaauugccucauccggcacacuggaguuuaacaaugaaagcuucaauuggacuggagucacucaaaauggaacaagcucugcuugcaaaaggagaucuaauagcagcuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31796 - RNA, 1701 nt, Artificial Sequence
  hemagglutinin__InfluenzaA__ABI92445
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagggggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucaaucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuagagaaccaacauacaauugaucuaacugacucagaaaugaacaaacuguuugaaagaacaaagaagcaacugagggaaaaugcugaggauaugggcaaugguuguuucaaaauauaccacaaaugugacaauaccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31797 - RNA, 1701 nt, Artificial Sequence; identical to SEQ ID NO: 31161
  hemagglutinin__InfluenzaA__ABI92456

SEQ ID NO: 31798 - RNA, 1701 nt, Artificial Sequence
  hemagglutinin__InfluenzaA__ABI92467
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaauggacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31799 - RNA, 1701 nt, Artificial Sequence; identical to SEQ ID NO: 31154
  hemagglutinin__InfluenzaA__ABI92478

SEQ ID NO: 31800 - RNA, 1701 nt, Artificial Sequence; identical to SEQ ID NO: 31798
  hemagglutinin__InfluenzaA__ABI92489

SEQ ID NO: 31801 - RNA, 1701 nt, Artificial Sequence
  hemagglutinin__InfluenzaA__ABI92500
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcaguaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31802 - RNA, 1701 nt, Artificial Sequence
  hemagglutinin__InfluenzaA__ABI92511
augaagacuaucauugcuuugagcuacauuuuaugucugguuuucgcucaaaaacuucccggaaaugacaacagcacagcgacgcugugccuggggcaccaugcagugccaaacggaacgcuagugaaaacaaucacgaaugaccaaauugaagugacuaaugcuacugagcugguucagaauuccucaacagguauaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucgcucagaauggaacaagcucugcuugcaaaaggagaucugauaaaaguuucuuuaguagauugaauugguugcaccaauuaaaauacaaauacccagcauugaacgugacuaugccaaacacugaaaaauuugacaaauuguacauuugggggguucaccacccgaguacggacagcgaccaaaucagccuauaugcucaagcaucagggagagucacagucucuaccaaaagaagccaacaaacuguaaucccgaauaucggaucuagacccuggguaaggggugucuccagcagaguaagcaucuauuggacaauaguaaaaccgggagacauacuuuugauuaacagcacagggaaucuaauugcuccucgggguuacuucaaaauacgaagugggaaaagcucaauaaugaggucagacgcauccauuggcaaaugcaauucuaaaugcaucacuccaaauggaagcauucccaaugacaaaccauuucaaaauguaaacaggaucacauauggggccugucccagguauguuaagcaaaacacucugaaauuggcaacagggaugcggaauguaccagagaaacaaacuagaggcauauucggcgcaaucgcggguuucauagaaaaugguugggagggaaugguggacgguugguacgguuucagacaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaauaccugcauaggaucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcaucuga

SEQ ID NO: 31803 - RNA, 1701 nt, Artificial Sequence
  hemagglutinin__InfluenzaA__ABI92522
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuauacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaagucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31804 - RNA, 1701 nt, Artificial Sequence
  hemagglutinin__InfluenzaA__ABI92533
augaagacuaucauugcuuugagcuacauuuuaugucugguuuucgcucaaaaacuucccggaaaugacaacagcagggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcgaaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31805 - RNA, 1701 nt, Artificial Sequence; identical to SEQ ID NO: 31804
  hemagglutinin__InfluenzaA__ABI92544

SEQ ID NO: 31806 - RNA, 1701 nt, Artificial Sequence
  hemagglutinin__InfluenzaA__ABI92577
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcagagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaagaagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaauugagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31807 - RNA, 1701 nt, Artificial Sequence
  hemagglutinin__InfluenzaA__ABI92588
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcagagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaagaagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccaggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31808 - RNA, 1701 nt, Artificial Sequence
  hemagglutinin__InfluenzaA__ABI92599
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcaacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguccaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaaaacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguugauugagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 31809 - RNA, 1701 nt, Artificial Sequence
  hemagglutinin__InfluenzaA__ABI92610
augaagacuaucauugcuuugagcuacauuuuaugccugguuuucgcucaaaaacuucccggaaaugacaacagcacggcaacgcugugccuggggcaucaugcggugccaaacggaacgcuagugaaaacaaucacgaaugaccaaauugaaguaacuaaugcuacugagcugguucagaguuccucaacagguagaauaugcgacaguccucaucaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccacgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaauuaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31810 - RNA, 1701 nt, Artificial Sequence
  hemagglutinin__InfluenzaA__ABI92621
augaagacuaucauugcuuugagcuacauuuuaugucugguuuucgcucaaaaacuucccggaaaugacaacagcauggcaacgcugugccuggggcaccaugcagugccaaacggaacgcuagugaaaacaaucacgaaugaccaaauugaagugacuaaugcuacugagcugguucagaguuccucaacagguagaauaugcaacaguccucaccaaauccuugauggagaaaacugcacacuaauagaugcucuauugggagacccucauugugaaggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaaaugcaauucugaaugcaucacuccaaauggaagcauucccaaugacaaaccauuucaaaauguaaacaggaucacauaugggcucugucccagauauguuaagcaaaacacucugaaauuggcaacggggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31811 - RNA, 1701 nt, Artificial Sequence
  hemagglutinin__InfluenzaA__ABI92632
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 31812 - RNA, 1701 nt, Artificial Sequence
  hemagglutinin__InfluenzaA__ABI92643
augaagacuaucauugcuuugagcuacauuuuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauuaaacgugacuauaccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaggcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31813 - RNA, 1701 nt, Artificial Sequence
  hemagglutinin__InfluenzaA__ABI92665
augaagacuaucauugcuuugagcuacauuuuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggggaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaggcaacugagggaaaaugcugaggauaugggcaaugguuguuucaaaauauaccacaaaugugacaaugccugcauagggucaaucagaaauggaacuuaugaccaugauguguacagaaaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31814 - RNA, 1701 nt, Artificial Sequence
  hemagglutinin__InfluenzaA__ABI92676
augaagacuaucauugcuuugagcuacauucuaugucugguuuuugcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaaaugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 31815 - RNA, 1701 nt, Artificial Sequence
  hemagglutinin__InfluenzaA__ABI92687
augaagacuaucauugcuuugagcuacauuuuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggggaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaggcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31816 - RNA, 1701 nt, Artificial Sequence; identical to SEQ ID NO: 31815
  hemagglutinin__InfluenzaA__ABI92698

SEQ ID NO: 31817 - RNA, 1701 nt, Artificial Sequence
  hemagglutinin__InfluenzaA__ABI92709
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucucgacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugauucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31818 - RNA, 1701 nt, Artificial Sequence
  hemagglutinin__InfluenzaA__ABI92720
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggaaagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggacaugggcaaugguuguuucaaaauauaccacaaaugugacaaugccugcauagggucaaucagaaauggaacuuaugaccaugauguguacagagaugaagcauuaaacaaccgauuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31819 - RNA, 1701 nt, Artificial Sequence
  hemagglutinin__InfluenzaA__ABI92731
augaagacuaucauugcuuugagcuacauuuuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaggcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31820 - RNA, 1701 nt, Artificial Sequence
  hemagglutinin__InfluenzaA__ABI92742
augaagacuaucauugcuuugagcuacauucuaugucugguuuuuucucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31821 - RNA, 1701 nt, Artificial Sequence
  hemagglutinin__InfluenzaA__ABI92753
augaagacuaucauugcuuugagcuacauuuuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccuaccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagaccaaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaggcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31822 - RNA, 1701 nt, Artificial Sequence
  hemagglutinin__InfluenzaA__ABI92764
augaagacuaucauugcuuugagcuacauuuugugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggggaucuaauaaaaguuucuuuaguagauugaauugguugacccacuuaaaauacaaauacccagcauugaacgugacuaugccaaacaaugaaaaauuugacaaauuguacauuugggggguucaccauccggguacggacagugaccaaaucagccuauaugcucaagcaucaggaagaaucacagucucuaccaaaagaagccaacaaacuguaaucccgaauaucggaucuagaccaaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaggcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31823 - RNA, 1701 nt, Artificial Sequence; identical to SEQ ID NO: 31815
  hemagglutinin__InfluenzaA__ABI92775

SEQ ID NO: 31824 - RNA, 1701 nt, Artificial Sequence
  hemagglutinin__InfluenzaA__ABI92786
augaagacuaucauugcuuugagcuacauucuaugucugguuuucgcucaaaaacuucccggaaaugacaacagcacggcaacgcugugccucgggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31825 - RNA, 1701 nt, Artificial Sequence
  hemagglutinin__InfluenzaA__ABI92797
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccccagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucucgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31826 - RNA, 1701 nt, Artificial Sequence; identical to SEQ ID NO: 31824
  hemagglutinin__InfluenzaA__ABI92808

SEQ ID NO: 31827 - RNA, 1701 nt, Artificial Sequence
  hemagglutinin__InfluenzaA__ABI92819
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccccagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31828 - RNA, 1701 nt, Artificial Sequence; identical to SEQ ID NO: 31824
  hemagglutinin__InfluenzaA__ABI92841

SEQ ID NO: 31829 - RNA, 1701 nt, Artificial Sequence
  hemagglutinin__InfluenzaA__ABI92852
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggauauagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31830 - RNA, 1701 nt, Artificial Sequence
  hemagglutinin__InfluenzaA__ABI92863
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaaaaaaugggaccuuuuuguugaacgcagcaaagcccacagcaacuguuacccuuaugaugugccggauuaugccucccuuaggucacuaauugccucauccggcacacuggaguuuaacaaugaaagcuucaauuggacuggagucacucagaauggaacaagcucugcuugcaaaaggagaucuaaucaaaguuucuuuaguagauugaauugguugacccauuuaaaauucaaauacccagcauugaacgugacuaugccaaacaaugaaaaauuugacaaauuguacauuugggggguucaccacccggguacggacagugaccaaaucagccuauaugcucaagcaccaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugaaaucagaugcacccauuggcagaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaauugcggguuucauagaaaaugguugggagggaaugguggacgguugguacgguuucaggcaucagaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucaugucuuuugcuuuguguugcuuuguugggguucaucaugugggccugccaaaaaggcaacauuaggugcaacauuugcauuuga

SEQ ID NO: 31831 - RNA, 1701 nt, Artificial Sequence; identical to SEQ ID NO: 31824
  hemagglutinin__InfluenzaA__ABI92874

SEQ ID NO: 31832 - RNA, 1701 nt, Artificial Sequence; identical to SEQ ID NO: 31824
  hemagglutinin__InfluenzaA__ABI92885

SEQ ID NO: 31833 - RNA, 1701 nt, Artificial Sequence
  hemagglutinin__InfluenzaA__ABI92907
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccuuaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaggcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31834 - RNA, 1701 nt, Artificial Sequence; identical to SEQ ID NO: 30822
  hemagglutinin__InfluenzaA__ABI92918

SEQ ID NO: 31835 - RNA, 1701 nt, Artificial Sequence
  hemagglutinin__InfluenzaA__ABI92929
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccuuaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31836 - RNA, 1701 nt, Artificial Sequence
  hemagglutinin__InfluenzaA__ABI92940
augaagacuaucauugcuuuuaacuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaaucuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaccaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagggaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31837 - RNA, 1701 nt, Artificial Sequence
  hemagglutinin__InfluenzaA__ABI92951
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaguucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaauuccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31838 - RNA, 1701 nt, Artificial Sequence
  hemagglutinin__InfluenzaA__ABI92962
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcaacaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagaaaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31839 - RNA, 1701 nt, Artificial Sequence
  hemagglutinin__InfluenzaA__ABI92973
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggggaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaguucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31840 - RNA, 1701 nt, Artificial Sequence
  hemagglutinin__InfluenzaA__ABI92984
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaacaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaguucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31841 - RNA, 1701 nt, Artificial Sequence
  hemagglutinin__InfluenzaA__ABI92995
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggauaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccaaauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaguucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31842 - RNA, 1701 nt, Artificial Sequence
  hemagglutinin__InfluenzaA__ABI93006
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31843 - RNA, 1701 nt, Artificial Sequence
  hemagglutinin__InfluenzaA__ABI93017
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaguucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31844 - RNA, 1698 nt, Artificial Sequence; identical to SEQ ID NO: 31736
  hemagglutinin__InfluenzaA__ABI93028

SEQ ID NO: 31845 - RNA, 1701 nt, Artificial Sequence; identical to SEQ ID NO: 31470
  hemagglutinin__InfluenzaA__ABI93039

SEQ ID NO: 31846 - RNA, 1701 nt, Artificial Sequence
  hemagglutinin__InfluenzaA__ABI93061
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31847 - RNA, 1701 nt, Artificial Sequence; identical to SEQ ID NO: 31154
  hemagglutinin__InfluenzaA__ABI93072

SEQ ID NO: 31848 - RNA, 1701 nt, Artificial Sequence; identical to SEQ ID NO: 31154
  hemagglutinin__InfluenzaA__ABI93083

SEQ ID NO: 31849 - RNA, 1701 nt, Artificial Sequence; identical to SEQ ID NO: 31154
  hemagglutinin__InfluenzaA__ABI93094

SEQ ID NO: 31850 - RNA, 1701 nt, Artificial Sequence
  hemagglutinin__InfluenzaA__ABI93105
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagcgaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccaggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31851 - RNA, 1701 nt, Artificial Sequence
  hemagglutinin__InfluenzaA__ABI93116
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaaugcgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugguguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31852 - RNA, 1689 nt, Artificial Sequence
  hemagglutinin__InfluenzaA__ABI94581
augaacacucaaauccugguauucgcucugguggcgagcauuccgacaaaugcagacaagaucugccuugggcaucaugccgugucaaacgggacuaaaguaaacacauuaacugagagaggaguggaagucguuaaugcaacugaaacgguggaacgaacaaacguucccaggaucugcucaaaagggaaaaggacaguugaccucggucaauguggacuucugggaacaaucacugggccaccccaaugugaccaauuccuagaauuuucggccgacuuaauuauugagaggcgagaaggaagugaugucuguuauccugggaaauucgugaaugaagaagcucugaggcaaauucucagagagucaggcggaauugacaaggagacaaugggauucaccuacagcggaauaagaacuaauggaacaaccagugcauguaggagaucaggaucuucauucuaugcagagaugaaauggcuccugucaaacacagacaaugcugcuuucccgcaaaugacuaagucauacaagaacacaaggaaagacccagcucugauaauaugggggauccaccauuccggaucaacuacagaacagaccaagcuauaugggaguggaaacaaacugauaacaguugggaguucuaauuaccaacaguccuuuguaccgaguccaggagcgagaccacaagugaauggccaaucuggaagaauugacuuucauuggcugauacuaaacccuaaugacacggucacuuucaguuucaauggggccuucauagcuccagaccgugcaagcuuucugagagggaaguccaugggaauucagagugaaguacagguugaugccaauugugaaggagauugcuaucauaguggagggacaauaauaaguaauuugcccuuucagaacauaaauagcagggcaguaggaaaauguccgagauauguuaagcaagagagucugcuguuggcaacaggaaugaagaauguucccgaaaucccaaagaggaggaggagaggccuauuuggugcuauagcggguuucauugaaaauggaugggaagguuugauugaugggugguauggcuucaggcaucaaaaugcacaaggggagggaacugcugcagauuacaaaagcacccaaucagcaauugaucaaauaacagggaaauuaaaucggcuuauagaaaaaacuaaccaacaguuugaguuaauagacaacgaauucacugagguugaaaagcaaauuggcaaugugauaaacuggaccagagauuccaugacagaagugugguccuauaacgcugaacucuuaguagcaauggagaaucagcacacaauugaucuggccgacucagaaaugaacaaacuguacgaacgagugaagagacaacugagagagaaugccgaagaagauggcacugguugcuucgaaauauuucacaagugugaugacgacugcauggccaguauuagaaacaacaccuaugaucacagcaaguacagggaagaagcaauacaaaauagaauacagauugacccagucaaacuaagcagcggcuacaaagaugugauacuuugguuuagcuucggggcaucauguuucauacuucuggccauugcaaugggccuugucuucauaugugugaagaauggaaacaugcggugcacuauuuguauauaa

SEQ ID NO: 31853 - RNA, 1701 nt, Artificial Sequence
  hemagglutinin__InfluenzaA__ABI95228
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccccaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcggguuucauagaaaaugguugggaaggaaugguggacgguugguacgguuucaggcaucaaaauucugagggcacaggacaagcagcagaucuuaaaagcacucaagcugcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31854 - RNA, 1701 nt, Artificial Sequence
  hemagglutinin__InfluenzaA__ABI95239
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaauggugaaugguugguacgguuucaggcaucaaaauucugagggaauaggacaagcagcagaucucaaaagcacucaagcagcaaucaaccaaaucaaugggaagcugaauagguugaucggaaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31855 - RNA, 1698 nt, Artificial Sequence
  hemagglutinin__InfluenzaA__ABI95250
augaaagcaaaacuacuaguccuguuauguacauuuacagcuacauaugcagacacaauauguguaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucuucauuugagagauucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaucugagcaaguccuauguaaacaacaaagagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagaggucaggaaggaagaaucaacuacuacuggacucugcuggaacccggggacacaauaauauuugaggcaaauggaaaucuaauagcgccaugguaugcuuucgcacugaguagaggcuuugggucaggaaucaucaccucaaaugcgccaaugaaugaaugugaugcaaagugucaaacaccucagggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 31856 - RNA, 1698 nt, Artificial Sequence
  hemagglutinin__InfluenzaA__ABI95261
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucuucauuugagagguucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaucugagcaaguccuauguaaacaacaaggagaaagaaguccuuguacuaugggguguucaucacccgucuaacauagggguccaaagggccaucuaucauacagaaaaugcuuaugucucuguagugucuucacauuauagcagaagauucaccccagaaauagcaaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuugagucaggaaucaucaccucaaaugcaccaaugaaugaaugugaugcaaagugucaaacaccucagggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuagucucccugggggcaaucagcuucuggauguguuccaaugggucuuugcaguguagaauaugcaucuga

SEQ ID NO: 31857 - RNA, 1698 nt, Artificial Sequence; identical to SEQ ID NO: 31736
  hemagglutinin__InfluenzaA__ABI95272

SEQ ID NO: 31858 - RNA, 1698 nt, Artificial Sequence; identical to SEQ ID NO: 31736
  hemagglutinin__InfluenzaA__ABI95283

SEQ ID NO: 31859 - RNA, 1698 nt, Artificial Sequence
  hemagglutinin__InfluenzaA__ABI95294
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcaaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaccagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31860 - RNA, 1698 nt, Artificial Sequence
  hemagglutinin__InfluenzaA__ABI96104
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugaucaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgcuaguucccugguucuuuuggucucccugggggcaaucagcuucuggauguguuccaaugggucuuugcaguguagaauaugcaucuga

SEQ ID NO: 31861 - RNA, 1701 nt, Artificial Sequence
  hemagglutinin__InfluenzaA__ABJ09107
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucauacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31862 - RNA, 1701 nt, Artificial Sequence
  hemagglutinin__InfluenzaA__ABJ09140
augaagacuaucauugcuuugagcuacauuuuaugucugguuuucgcucaaaaacuucccggaaaugacaacagcacagcaacgcugugccugggacaccaugcggugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggaaaagcuauucuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucggguuuagacccuggguaaggggucuguccaguagaauaagcaucuauuggacaauaguaaaaccgggagacauacuuuugauuaauagcacagggaaucuaauugcuccucgggguuacuucaaaauacggaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggggcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31863 - RNA, 1698 nt, Artificial Sequence
  hemagglutinin__InfluenzaA__ABJ09151
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagggaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccaaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 31864 - RNA, 1701 nt, Artificial Sequence
  hemagglutinin__InfluenzaA__ABJ09162
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucagacaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagauucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31865 - RNA, 1701 nt, Artificial Sequence
  hemagglutinin__InfluenzaA__ABJ09173
augaagacuaucauugcuuugagcuacauucuaugucugguuuucgcucaaaaacuucccggaaaugacaacagcacggcaacgcuaugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauagugaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31866 - RNA, 1698 nt, Artificial Sequence
  hemagglutinin__InfluenzaA__ABJ09184
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaagucuuaugcaaacaacaaagaaaaagaaguccuuguacuaugggguguucaucacccgccuaacauaggggaccaaagggcucucuaucauacagaaaaugcuuaugucucuguagugucuucacauuauagcagaagauucaccccagaaauagccaaaagacccaaggugagagaucaggaaggaagaaucaacuacuacuggacacugcuggaagccggggauacaauaauauuugaggcaaauggaaaucuaauagcgccaagguuugcuuucgcacugaguagaggcuuuggaucaggaaucaucaccucaaaugcaccaauggaugaaugugaugcaaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugaaaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccacgacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31867 - RNA, 1701 nt, Artificial Sequence; identical to SEQ ID NO: 31161
  hemagglutinin__InfluenzaA__ABJ09195

SEQ ID NO: 31868 - RNA, 1701 nt, Artificial Sequence; identical to SEQ ID NO: 31137
  hemagglutinin__InfluenzaA__ABJ09206

SEQ ID NO: 31869 - RNA, 1701 nt, Artificial Sequence
  hemagglutinin__InfluenzaA__ABJ09217
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuaccgagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuagaguuuaucaaugaagacuucaauuggacuggaguagcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaucccgaauaucgggucuagacccuggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31870 - RNA, 1701 nt, Artificial Sequence
  hemagglutinin__InfluenzaA__ABJ09228
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggagcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucauacaacgcggagcuucuuguugcucuggagaaccagcauacaauugaucuaacugacucagaaaugaacaaacuauuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31871 - RNA, 1701 nt, Artificial Sequence
  hemagglutinin__InfluenzaA__ABJ09239
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuagauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacaauggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccgaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaaaaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31872 - RNA, 1701 nt, Artificial Sequence
  hemagglutinin__InfluenzaA__ABJ09250
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggauucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31873 - RNA, 1701 nt, Artificial Sequence
  hemagglutinin__InfluenzaA__ABJ09261
augaagacuaucauugcuuugagcuacauuuuaugucugguuuucgcucaaaaacuucccggaaaugacaacagcacggcaacacugugccugggacaccaugcagugccaaacggaacgcuagugaaaacaaucacgaaugaccaaauugaagugacuaaugcuacugagcugguucagaguuccucaacagguaaaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaucacccgaguacggacagugaccaaaccagccuauaugcucaagcaucagggagagucacagucucuaccaaaagaagccaacaaacuguaaucccgaauaucggaucuagacccuggguaaggggugucucaagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggaauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacggaaaacugaauagguuaaucgagaaaacaaacgagaaauaccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31874 - RNA, 1701 nt, Artificial Sequence
  hemagglutinin__InfluenzaA__ABJ09272
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcaacaguccucaccaaauccuugauggagaaaacugcacacuaauagaugcucuauugggagacccucauugugauggcuuccaaaauaaggaaugggaccuuuuuguugaacgcagaaaagccuacagcaacuguuacccuuaugaugugccggauuaugccucccuuaggucacuaguugccucaucuggcacacuggaguuuaacaaugaaagcuucaacuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaagauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31875 - RNA, 1701 nt, Artificial Sequence
  hemagglutinin__InfluenzaA__ABJ09294
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcuuggguucaucaugugggccugccaaaaaggcaacauuaggugcaacauuugcauuuga

SEQ ID NO: 31876 - RNA, 1701 nt, Artificial Sequence
  hemagglutinin__InfluenzaA__ABJ09305
augaagacuaucauugcuuugagcuacauuuuaugucugguuuucgcucaaaaacuucccggaaaugacaacagcacggcaacgcugugccuggggcaccaugcagugccaaacggaacgcuagugaaaacaauaacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugaaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31877 - RNA, 1701 nt, Artificial Sequence
  hemagglutinin__InfluenzaA__ABJ09316
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacagacagugaccaaaucagccuauaugcucaagcaucagggagagucacagucucuaccaaaagaagccaacaaacuguaaucccgaauaucggaucuagacacuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31878 - RNA, 1701 nt, Artificial Sequence
  hemagglutinin__InfluenzaA__ABJ09338
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacuccgaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31879 - RNA, 1701 nt, Artificial Sequence
  hemagglutinin__InfluenzaA__ABJ09349
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugauucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuuggggaguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31880 - RNA, 1701 nt, Artificial Sequence
  hemagglutinin__InfluenzaA__ABJ09360
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaucaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31881 - RNA, 1701 nt, Artificial Sequence
  hemagglutinin__InfluenzaA__ABJ09371
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacucaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuagagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31882 - RNA, 1701 nt, Artificial Sequence; identical to SEQ ID NO: 31137
  hemagglutinin__InfluenzaA__ABJ09382

SEQ ID NO: 31883 - RNA, 1701 nt, Artificial Sequence
  hemagglutinin__InfluenzaA__ABJ16587
augaagacuaucauugcuuugagcuacauuucaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuaaaauacagauauccagcacugaacgugacuaugccaaacaaugacaaauuugacaaauuguacauuugggggguucaccacccgaguacggacagugaccaaaccagccuauaugcccaagcaucagggagagucacagucucuaccaaaagaagccaacaaacuguaaucccaaauaucggauccagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 31884 - RNA, 1701 nt, Artificial Sequence
  hemagglutinin__InfluenzaA__ABJ16598
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcaacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucaucuggcacacuggaguuuaacaaugaaagcuucaacuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccaaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31885 - RNA, 1701 nt, Artificial Sequence
  hemagglutinin__InfluenzaA__ABJ16620
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcaacaguccucaccaaauccuugauggagaaaacugcacacuaauagaugcucuauugggagacccucauugugauggcuuccaaaauaaggaaugggaccuuuuuguugaacgcaacaaagccuacagcaacuguuacccuuaugaugugccggauuaugccucccuuaggucacuaguugccucaucuggcacacuggaguuuaacaaugaaagcuucaacuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacaagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuugugucguuuugcugggguucaucaugugggccugccaaaaaggcaacauuaggugcaacauuugcauuuga

SEQ ID NO: 31886 - RNA, 1701 nt, Artificial Sequence
  hemagglutinin__InfluenzaA__ABJ16631
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugcuugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31887 - RNA, 1698 nt, Artificial Sequence
  hemagglutinin__InfluenzaA__ABJ16664
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucugcuaaaaggaauagccccacuacaauuggguaacugcagcguugccggauggaucuuaggaaacccagaaugcgaauuacugauuuccaaggaaucaugguccuacauuguagaaacaccaaauccugagaauggaacauguuacccagggcauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31888 - RNA, 1698 nt, Artificial Sequence
  hemagglutinin__InfluenzaA__ABJ16675
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31889 - RNA, 1698 nt, Artificial Sequence
  hemagglutinin__InfluenzaA__ABJ16686
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaagaacuuuggauuuccaugacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31890 - RNA, 1701 nt, Artificial Sequence
  hemagglutinin__InfluenzaA__ABJ16697
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuugugcugucuugcugggguucaucaugugggccugccaaaaaggcaacauuagaugcaacauuugcauuuga

SEQ ID NO: 31891 - RNA, 1701 nt, Artificial Sequence
  hemagglutinin__InfluenzaA__ABJ16730
augaaagcaaaacuacuaguucuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaagaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaacgcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaaaccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 31892 - RNA, 1701 nt, Artificial Sequence
  hemagglutinin__InfluenzaA__ABJ16741
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacaaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaagguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgggaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31893 - RNA, 1701 nt, Artificial Sequence
  hemagglutinin__InfluenzaA__ABJ16752
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcggaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31894 - RNA, 1701 nt, Artificial Sequence
  hemagglutinin__InfluenzaA__ABJ16763
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacacuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31895 - RNA, 1701 nt, Artificial Sequence
  hemagglutinin__InfluenzaA__ABJ16774
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccccaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaaaugggaaaagcucaauaaugaggucaaauacacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcggguuucauagaaaaugguugggaaggaaugguggacgguugguacgguuucaggcaucaaaauucugagggcacaggacaagcagcagaucuuaaaagcacucaagcugcaaucaaccaaaucaacgggaaacugaauagguuaaucgagaaaacaaacgagaaauuccaucaaauugaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31896 - RNA, 1701 nt, Artificial Sequence
  hemagglutinin__InfluenzaA__ABJ16785
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcuaugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31897 - RNA, 1701 nt, Artificial Sequence
  hemagglutinin__InfluenzaA__ABJ53438
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggaguaacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugacugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 31898 - RNA, 1698 nt, Artificial Sequence; identical to SEQ ID NO: 31246
  hemagglutinin__InfluenzaA__ABJ53449

SEQ ID NO: 31899 - RNA, 1701 nt, Artificial Sequence
  hemagglutinin__InfluenzaA__ABJ53471
augaagacuaucauugcuuugagcuacauucuaugucugguuuucgcucaaaaaauucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuucugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguguacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31900 - RNA, 1701 nt, Artificial Sequence
  hemagglutinin__InfluenzaA__ABJ53482
augaagacuaucauugcuuugagcuacauucuaugucugguuuucgcucaaaaacuucccggaaaugacaacagcacggcaacgcugugccucgggcaccaugcaguaccaaacggaacgauagugagaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugagagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaaggagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31901 - RNA, 1698 nt, Artificial Sequence; identical to SEQ ID NO: 31736
  hemagglutinin__InfluenzaA__ABJ53493

SEQ ID NO: 31902 - RNA, 1698 nt, Artificial Sequence
  hemagglutinin__InfluenzaA__ABJ53504
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucuucauuugagagguucgaaauauuccccaaagaaagcucauggcccaaccacaccguaaccggaguaucggcaucaugcucccauaaugggaaaagcaguuuuuacagaaauuugcuauggcugacggagaagaauggcuuguacccaaaucugagcaaguccuauguaaacaacaaggagaaagaaguccuuguacuaugggguguucaucacccgucuaacauagggguccaaagggccaucuaucauacagaaaaugcuuaugucucuguagugucuucacauuauagcagaagauucaccccagaaauagcaaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuugagucaggaaucaucaccucaaaugcaccaaugaaugaaugugaugcaaagugucaaacaccucugggagcuauaaacaguagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugauagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuagucucccugggggcaaucagcuucuggauguguuccaaugggucuuugcaguguagaauaugcaucuga

SEQ ID NO: 31903 - RNA, 1701 nt, Artificial Sequence
  hemagglutinin__InfluenzaA__ABJ53515
augaaagcaaaacuacuaguucuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaagaagacccaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaacgcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacacaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaaaccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 31904 - RNA, 1701 nt, Artificial Sequence
  hemagglutinin__InfluenzaA__ABK39962
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguccaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaaaacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguugauugagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 31905 - RNA, 1701 nt, Artificial Sequence
  hemagglutinin__InfluenzaA__ABK39973
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaucacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31906 - RNA, 1701 nt, Artificial Sequence
  hemagglutinin__InfluenzaA__ABK39984
augaagacuaucauugcuuugagcuacauucuaugucugguuuucgcucaaaaacuucccggaaaugacaacagcagggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcaccuauuggcaaaugcaacucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31907 - RNA, 1698 nt, Artificial Sequence
  hemagglutinin__InfluenzaA__ABK39995
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguauauucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauagggaaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 31908 - RNA, 1701 nt, Artificial Sequence
  hemagglutinin__InfluenzaA__ABK40017
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaauaaaaaauuugacaaacuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31909 - RNA, 1701 nt, Artificial Sequence
  hemagglutinin__InfluenzaA__ABK40028
augaaagcaaaacuacuaguucuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuacuguguugucuucacauuauagcagaagauucaccccagaaauagcaagaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaacgcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaaaccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 31910 - RNA, 1701 nt, Artificial Sequence
  hemagglutinin__InfluenzaA__ABK40039
augaaagcaaaacuacuaguucuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaagaagacccaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaacgcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaaaccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 31911 - RNA, 1701 nt, Artificial Sequence; identical to SEQ ID NO: 31891
  hemagglutinin__InfluenzaA__ABK40050

SEQ ID NO: 31912 - RNA, 1701 nt, Artificial Sequence; identical to SEQ ID NO: 31154
  hemagglutinin__InfluenzaA__ABK40061

SEQ ID NO: 31913 - RNA, 1701 nt, Artificial Sequence; identical to SEQ ID NO: 31154
  hemagglutinin__InfluenzaA__ABK40075

SEQ ID NO: 31914 - RNA, 1701 nt, Artificial Sequence; identical to SEQ ID NO: 31425
  hemagglutinin__InfluenzaA__ABK40510

SEQ ID NO: 31915 - RNA, 1701 nt, Artificial Sequence; identical to SEQ ID NO: 31425
  hemagglutinin__InfluenzaA__ABK40534

SEQ ID NO: 31916 - RNA, 1701 nt, Artificial Sequence
  hemagglutinin__InfluenzaA__ABK40546
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaauaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31917 - RNA, 1701 nt, Artificial Sequence; identical to SEQ ID NO: 31425
  hemagglutinin__InfluenzaA__ABK40557

SEQ ID NO: 31918 - RNA, 1701 nt, Artificial Sequence; identical to SEQ ID NO: 31425
  hemagglutinin__InfluenzaA__ABK40568

SEQ ID NO: 31919 - RNA, 1701 nt, Artificial Sequence
  hemagglutinin__InfluenzaA__ABK40579
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacugggaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31920 - RNA, 1701 nt, Artificial Sequence
  hemagglutinin__InfluenzaA__ABK40590
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccucguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaaaccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31921 - RNA, 1701 nt, Artificial Sequence
  hemagglutinin__InfluenzaA__ABK40601
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucgugguccuacauugcagaaacaccaaacuccgagaauggaacauguuacccaggguauuucgcagacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31922 - RNA, 1701 nt, Artificial Sequence; identical to SEQ ID NO: 31154
  hemagglutinin__InfluenzaA__ABK40612

SEQ ID NO: 31923 - RNA, 1701 nt, Artificial Sequence
  hemagglutinin__InfluenzaA__ABK40623
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacggguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaaguggaaaaagcucaauaaugaggucaaaugcacccauuggcaaaugcaauucugaaugcaucacuccaaauggaagcauucccaaugacaaaccauuucaaaauguaaacaggaucgcauauggggccugucccagauauguuaagcaaaacacucugaaauuggcaacagggaugcggaauguaccagagaaacaaacuagaggcauauucggcgcaaucgcggguuucauagaaaaugguugggaggggaugguggacgguugguacgguuucaggcaucuaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguuaaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggaugugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31924 - RNA, 1701 nt, Artificial Sequence
  hemagglutinin__InfluenzaA__ABK40645
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuaugcuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaccaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccaaaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31925 - RNA, 1701 nt, Artificial Sequence
  hemagglutinin__InfluenzaA__ABK40656
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccccaacagguagaauaugcgacaguccucaccgaauccuugauggaaagaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaacgaaaacuucaauuggacuggagucgcucaggaugggaaaagcuauucuugcaaaaggggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguccgagcaucagggaaagucacagucucuaccaaaagaagccaacaaacuguaaucccggauaucggguauagaccauggguaaggggucuguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacaggaucacauaugggaccugccccagauauguuaagcaaaacacacugaaauuggcaacagggaugcggaauguaccagagaaacaaacuagaggcauauucggcgcaaucgcagguuucauagaaaaugguugggagggaaugguagacgguugguacgguuucaggcaucagaauucugagggcacaggacaagcugcagaucuuaaaagcacucaagcagcaaucgaccaaaucaacgggaaacugaauagguuagucgagaaaacgaacgagaaauuccaucaaaucgaaaaagaauucucagaaguagaagggagaauucaggaccucgagaaauauguugaagacacuaaaauagaucucuggucuuacaaugcggagcuucuuguugcucuggagaaucaacauacaauugaucuaacugacucagaaaugaacaaacuauuugaaagaacaaggaagcaacugagggaaaaugcugaggacaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcuuggguucaucaugugggccugccaaaaaggcaacauuaggugcaacauuugcauuuga

SEQ ID NO: 31926 - RNA, 1701 nt, Artificial Sequence
  hemagglutinin__InfluenzaA__ABK40667
augaagacuaucauugcuuugagcuacauuuuaugucugguuuucgcucaaaaacuucccggaaaugacaacagcacagcaacgcugugccugggacaccaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaaggcuucaauuggacuggagucgcucaggaugggaaaagcuaugcuugcaaaagaggaucuguuaacaguuucuuuaguagauugaauugguugcacaaauuagaauacaaauauccagcacugaacgugacuaugccaaacaaugacaaauuugacaaauuguacauuugggggguucaccacccgagcacagacagugaccaaaccagccuauauguucaagcaucagggagagucacagucucuaccaaaagaagccaacaaacuguaaucccgaauaucgggucuagacccuggguaagggguaucuccaguagaauaagcaucuauuggacaauaguaaaaccgggagacauacuuuugauuaacagcacagggaaucuaauugcuccucgagguuacuucaaauuacgaaaugggaaaagcucaauaaugagaucagaugcacccauugacaacugcaauucugaaugcaucacuccaaauggaagcauucccaaugacaaaccuuuucaaaaugugaacaggaucacauauggggccugucccagauauguuaagcaaaacacucugaaguuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagauuaaccgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuauaaccaugauguauacagagacgaagcauuaaacaaccgguuccagaucaaagguguugagcugaagucagguuacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 31927 - RNA, 1701 nt, Artificial Sequence; identical to SEQ ID NO: 31570
  hemagglutinin__InfluenzaA__ABK40678

SEQ ID NO: 31928 - RNA, 1698 nt, Artificial Sequence
  hemagglutinin__InfluenzaA__ABK40689
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaagucuuaugcaaacaacaaagaaaaagaaguccuuguacuaugggguguucaucacccgccuaacauagggaaccaaagggcucucuaucauacagaaaaugcuuaugucucuguagugucuucacauuauagcagaagauucaccccagaaauagccaaaagacccaaggugagagaucaggaaggaagaaucaacuacuacuggacacugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcaaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugaaaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccacgacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31929 - RNA, 1701 nt, Artificial Sequence; identical to SEQ ID NO: 31154
  hemagglutinin__InfluenzaA__ABK40700

SEQ ID NO: 31930 - RNA, 1701 nt, Artificial Sequence
  hemagglutinin__InfluenzaA__ABK40711
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugaaggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcucuggagaaccagcauacaauugaucuaacugacucagaaaugaacaaacuauuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31931 - RNA, 1701 nt, Artificial Sequence
  hemagglutinin__InfluenzaA__ABK40722
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacaaugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31932 - RNA, 1701 nt, Artificial Sequence
  hemagglutinin__InfluenzaA__ABK40733
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugaccaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggagcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcucuggagaaccagcauacaauugaucuaacugacucagaaaugaacaaacuauuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31933 - RNA, 1701 nt, Artificial Sequence; identical to SEQ ID NO: 31809
  hemagglutinin__InfluenzaA__ABK40744

SEQ ID NO: 31934 - RNA, 1701 nt, Artificial Sequence; identical to SEQ ID NO: 31420
  hemagglutinin__InfluenzaA__ABK79948

SEQ ID NO: 31935 - RNA, 1698 nt, Artificial Sequence
  hemagglutinin__InfluenzaA__ABK79959
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuuacuauggcugacggggaagaaugguuuguauccaaaucugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaagguaagagaucaggaaggaaggaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 31936 - RNA, 1701 nt, Artificial Sequence
  hemagglutinin__InfluenzaA__ABK79970
augaaagcaaaacuacuaguucuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaagaaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaagaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaacgcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaaaccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 31937 - RNA, 1701 nt, Artificial Sequence
  hemagglutinin__InfluenzaA__ABK79981
augaagacuaucauugcuuugagcuacauuuuaugucugguuuucacucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31938 - RNA, 1701 nt, Artificial Sequence; identical to SEQ ID NO: 31154
  hemagglutinin__InfluenzaA__ABK79992

SEQ ID NO: 31939 - RNA, 1701 nt, Artificial Sequence; identical to SEQ ID NO: 31425
  hemagglutinin__InfluenzaA__ABK80025

SEQ ID NO: 31940 - RNA, 1701 nt, Artificial Sequence; identical to SEQ ID NO: 31425
  hemagglutinin__InfluenzaA__ABK80036

SEQ ID NO: 31941 - RNA, 1701 nt, Artificial Sequence; identical to SEQ ID NO: 31473
  hemagglutinin__InfluenzaA__ABK80047

SEQ ID NO: 31942 - RNA, 1701 nt, Artificial Sequence
  hemagglutinin__InfluenzaA__ABK80058
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccccaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcggguuucauagaaaaugguugggaaggaaugguggacgguugguacgguuucaggcaucaaaauucugagggcacaggacaagcagcagaucuuaaaagcacucaagcugcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuagaugcaacauuugcauuuga

SEQ ID NO: 31943 - RNA, 1701 nt, Artificial Sequence
  hemagglutinin__InfluenzaA__ABK80069
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacggguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggauaaggggugucuccagcagaauaagcaucuauuggacaauaguaaaaccgggagacauacuuuugauuaacagcacagggaaucuaauugcuccucgggguuacuuuaaaauacgaaguggaaaaagcucaauaaugaggucaaaugcacccauuggcaaaugcaauucugaaugcaucacuccaaauggaagcauucccaaugacaaaccauuucaaaauguaaacaggaucgcauauggggccugucccagauauguuaagcaaaacacucugaaauuggcaacagggaugcggaauguaccagagaaacaaacuagaggcauauucggcgcaaucgcggguuucauagaaaaugguugggaggggaugguggacgguugguacgguuucaggcaucuaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggaugugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31944 - RNA, 1701 nt, Artificial Sequence
  hemagglutinin__InfluenzaA__ABK80080
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugaacugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagauuaaucgagaaaacaaacgagaaauuccaucaaauugaaaaggaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuuaaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuagaugcaacauuugcauuuga

SEQ ID NO: 31945 - RNA, 1701 nt, Artificial Sequence; identical to SEQ ID NO: 31154
  hemagglutinin__InfluenzaA__ABK80091

SEQ ID NO: 31946 - RNA, 1701 nt, Artificial Sequence; identical to SEQ ID NO: 31154
  hemagglutinin__InfluenzaA__ABK80102

SEQ ID NO: 31947 - RNA, 1701 nt, Artificial Sequence
  hemagglutinin__InfluenzaA__ABK80113
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31948 - RNA, 1701 nt, Artificial Sequence
  hemagglutinin__InfluenzaA__ABK80124
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaaaauuggauccuauggauuuccuuugccauaucauguuuuuugcuuuguauuguuuugcugggguucaucaugugggccugccaaaaaggcaacauuaggugcaacauuugcauuuga

SEQ ID NO: 31949 - RNA, 1701 nt, Artificial Sequence; identical to SEQ ID NO: 31947
  hemagglutinin__InfluenzaA__ABK80135

SEQ ID NO: 31950 - RNA, 1701 nt, Artificial Sequence; identical to SEQ ID NO: 31947
  hemagglutinin__InfluenzaA__ABK80146

SEQ ID NO: 31951 - RNA, 1701 nt, Artificial Sequence; identical to SEQ ID NO: 31947
  hemagglutinin__InfluenzaA__ABK80157

SEQ ID NO: 31952 - RNA, 1701 nt, Artificial Sequence; identical to SEQ ID NO: 31066
  hemagglutinin__InfluenzaA__ABK80168

SEQ ID NO: 31953 - RNA, 1701 nt, Artificial Sequence
  hemagglutinin__InfluenzaA__ABK80179
augaagacuaucauugcuuugagcuacauuuuaugccugguuuucgcucaaaaacuucccggaaaugacaacagcacggcaacgcugugccuggggcaucaugcggugccaaacggaacgcuagugaaaacaaucacgaaugaccaaauugaaguaacuaaugcuacugagcugguucagaguuccucaacagguagaauaugcgacaguccucaucaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcguucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccggcuccagaucaaagguguugagcugaagucaggauacaaagauuggauccuauggauuuccuuugccauaucauguuuuuugcuuuguauuguucugcugggguucaucaugugggccugccaaaaaggcaacauuaggugcaacauuugcauuuga

SEQ ID NO: 31954 - RNA, 1701 nt, Artificial Sequence
  hemagglutinin__InfluenzaA__ABK80190
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuucuugcuuuguauuguuuugcugggguucaucaugugggccugccaaaaaggcaacauuaggugcaacauuugcauuuga

SEQ ID NO: 31955 - RNA, 1701 nt, Artificial Sequence
  hemagglutinin__InfluenzaA__ABK80201
augaagacuaucauugcuuugagcuacauuuuaugccugguuuucgcucaaaaacuucccggaaaugacaacagcacggcaacgcugugccuggggcaucaugcggugccaaacggaacgcuagugaaaacaaucacgaaugaccaaauugaaguaacuaaugcuacugagcugguucagaguuccucaacagguagaauaugcgacaguccucaucaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuuaauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31956 - RNA, 1701 nt, Artificial Sequence
  hemagglutinin__InfluenzaA__ABK80212
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaaaauuggauccuauggauuuccuuugccauaucauguuuuuugcuuuguguugcuuuguugggguucaucaugugggccugccaaaaaggcaacauuaggugcaacauuugcauuuga

SEQ ID NO: 31957 - RNA, 1701 nt, Artificial Sequence; identical to SEQ ID NO: 31024
  hemagglutinin__InfluenzaA__ABK80223

SEQ ID NO: 31958 - RNA, 1701 nt, Artificial Sequence
  hemagglutinin__InfluenzaA__ABK80234
augaggacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31959 - RNA, 1701 nt, Artificial Sequence
  hemagglutinin__InfluenzaA__ABK80245
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaauugccucauccggcacacuggaguuuaacaaugaaagcuucaauuggacuggagucacucagaauggaacaagcucugcuugcaaaaggagaucuaaucaaaguuucuuuaguagauugaauugguugacccauuuaaaauucaaauacccagcauugaacgugacuaugccaaacaaugaaaaauuugacaaauuguacauuugggggguucaccacccggguacggacagugaccaaaucagccuauaugcucaagcaccaggaagaaucacagucucuaccaaaagaagccaacaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaauacgaagugggaaaagcucaauaaugaaaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaaugugccagagaaacaaacuagaggcauauuuggcgcaauugcggguuucauagaaaaugguugggagggaaugguggacgguugguacgguuucaggcaucagaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucaugucuuuugcuuuguguugcuuuguugggguucaucaugugggccugccaaaaaggcaacauuaggugcaacauuugcauuuga

SEQ ID NO: 31960 - RNA, 1701 nt, Artificial Sequence; identical to SEQ ID NO: 31959
  hemagglutinin__InfluenzaA__ABK80256

SEQ ID NO: 31961 - RNA, 1701 nt, Artificial Sequence
  hemagglutinin__InfluenzaA__ABK80267
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31962 - RNA, 1701 nt, Artificial Sequence
  hemagglutinin__InfluenzaA__ABK80278
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauuaaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31963 - RNA, 1701 nt, Artificial Sequence
  hemagglutinin__InfluenzaA__ABK80289
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaguuugacaaauuguacauuugggggguucaccacccggguacggacaaugaccaaaucuuccuguaugcucaagcaucaggaagaaucacaguuucuaccaaaagaagccaacaaacuguaaucccgaauaucggaucuagacccagaguaaggaauauccccaguagaauaagcauauauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31964 - RNA, 1701 nt, Artificial Sequence
  hemagglutinin__InfluenzaA__ABK80300
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaggaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31965 - RNA, 1701 nt, Artificial Sequence
  hemagglutinin__InfluenzaA__ABK80311
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggacccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31966 - RNA, 1707 nt, Artificial Sequence
  hemagglutinin__InfluenzaA__ABL07019
auggagaaaauagugcuucuucuuucaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaacguaccggaauggucuuacauaguggaaaaggccaauccaaccaaugaccucuguuacccagggaguuucaacgacuaugaagaacugaaacaccuauugagcagaauaaaccauuuugagaaaauucagaucauccccaaaaguucuugguccgaucaugaagccucaucaggagugagcucagcauguccauaccugggaagucccuccuuuuuuagaaaugugguauggcuuaccaaaaagaacaguacauacccaacaauaaagaaaagcuacaauaauaccaaccaagaagaucuuuugguacuguggggaauucaccauccuaauaaugaggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccaaaugaugcaaucaacuucgagaguaauggaaauuucauugcuccagaauaugcauacaaaauugucaagaaaggggacucagcaauuaugaaaagugaauuggaauauaguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggucuauuuggagcuauagcagguuuuauagagggaggauggcagggaaugguagaugguugguauggguaccaccauaguaaugagcaggggaguggguacgcugcagacaaagaaucuacucaaaaggcaauagauggagucaccaauaaggucaacucaauuauugacaaaaugaacacucaguuugaggccguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuaugacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaguuggaaucaauaggaacuuaccaaauacugucaauuuacucaacaguggcgaguucccuagcacuggcaaucaugauagcuggucuaucuuuauggaugugcuccaauggaucguuacaaugcagaauuugcauuuaa

SEQ ID NO: 31967 - RNA, 1707 nt, Artificial Sequence
  hemagglutinin__InfluenzaA__ABL07030
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaucuauugagccgaauaaaccauuuugagaaaauucaaaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccaucccaaugaugcagcagagcagacaaggcuauaucaaaacccaaccaccuauauuuccauugggacaucaacacuaaaccagagauugguaccaaaaauagcuacuagauccaaaguaaacgggcaaaguggaaggauggaguucuucugggcaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggacuauuuggagcuauagcagguuuuauagagggaggauggcagggaaugguagauggcugguauggguaccaccauagcaaugagcaggggaguggguacgcugcagacaaagaauccacucaaaaggcaauagauggagucaccaauaaggucaacucaauuauugacaaaaugaacacucaguuugaggcuguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuacgacaagguccgacuacagcuuagggauaaugcaaaagagcuggguaacgguuguuucgaguucuaucacaaaugugauaaugaauguauggaaaguauaagaaacggaacguacaacuauccgcaguauucagaagaagcaagauuaaaaagggaggaaauaagugggguaaaauuggaaucaauaggaacuuaccaaauacugucaauuuauucaacaguagcgaguucccuagcacuggcaaucaugauagcuggucuaucuuuauggaugugcuccaauggaucguuacaaugcagaauuugcauuuaa

SEQ ID NO: 31968 - RNA, 1707 nt, Artificial Sequence
  hemagglutinin__InfluenzaA__ABL10088
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaaugguccuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccgaaguaaacgggcaaaguggaaggauggaguucuucuggacaauuuuaaaaccgaaugaugcaaucaacuucgagaguaauggaaauuucguugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcaaacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggaacuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 31969 - RNA, 1707 nt, Artificial Sequence
  hemagglutinin__InfluenzaA__ABL31766
auggagaaaauagugcuucuucuugcaauagucaguuuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaucuauugagcagaauaaaccauuuugagaaaauucaaaucauccccaaaaguuccugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaaugaugcggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucugggcaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggacuauuuggagcuauagcagguuuuauagagggaggauggcagggaaugguagauggcugguauggguaccaccauagcaaugagcaggggaguggguacgcugcagacaaagaauccacucaaaaggcaauagauggagucaccaauaaggucaacucaauuauugacaaaaugaacacucaguuugaggcuguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuacgacaagguccgacuacagcuuagggauaaugcaaaagagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguagcgaguucccuagcacuggcaaucaugauagcuggucuaucuuuauggaugugcuccaauggaucguuacaaugcagaauuugcauuuaa

SEQ ID NO: 31970 - RNA, 1707 nt, Artificial Sequence
  hemagglutinin__InfluenzaA__ABL31780
auggagaaaauaguacuucuucuuucaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaacguaccggaauggucuuacauaguggagaaggccaauccaaccaaugaccucuguuacccagggaguuucaacgacuaugaagaacugaaacaccuauugagcagaauaaaccauuuugagaaaauucagaucauccccaaagguucuugguccgaucaugaagccucaucaggagugagcucagcauguccauaccugagaagucccuccuuuuuuagaaaugugguauggcuuaucaaaaagaacaguacauacccaacaauaaagaaaagcuacaauaauaccaaccaagaagaucuuuugguacuguggggaauucaccauccuaauaaugaggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccaaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggucuauuuggagcuauagcagguuuuauagagggaggauggcagggaaugguagaugguugguauggguaccaccauagcaaugagcaggggaguggguacgcugcagacaaagaaucuacucaaaaggcaauagauggagucaccaauaaggucaacucaauuauugacaaaaugaacacucaguuugaggccguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaaaaaccucuaugacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaguuggaaucaauaggaacuuaccaaauacugucaauuuacucaacaguggcgaguucccuagcacuggcaaucaugauagcuggucuaucuuuauggaugugcuccaauggaucguuacaaugcagaauuugcauuuaa

SEQ ID NO: 31971 - RNA, 1701 nt, Artificial Sequence
  hemagglutinin__InfluenzaA__ABL67165
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacaaguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaaaaaacuagaggcauauuuggcgcaaucgcagguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31972 - RNA, 1701 nt, Artificial Sequence
  hemagglutinin__InfluenzaA__ABL67176
augaagacuaucauugcuuugagcuacauuuuaugucugguuuucacucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcagagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 31973 - RNA, 1701 nt, Artificial Sequence; identical to SEQ ID NO: 31936
  hemagglutinin__InfluenzaA__ABL67187

SEQ ID NO: 31974 - RNA, 1701 nt, Artificial Sequence; identical to SEQ ID NO: 31891
  hemagglutinin__InfluenzaA__ABL67209

SEQ ID NO: 31975 - RNA, 1701 nt, Artificial Sequence; identical to SEQ ID NO: 31473
  hemagglutinin__InfluenzaA__ABL67253

SEQ ID NO: 31976 - RNA, 1701 nt, Artificial Sequence
  hemagglutinin__InfluenzaA__ABL67264
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguaguuuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 31977 - RNA, 1701 nt, Artificial Sequence
  hemagglutinin__InfluenzaA__ABL67275
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacggguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaaguggaaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaggggaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggaugugggcaaugguuguuucaaaauauaccacaaaugugacaaugccugcauagggucaaucagaaauggaacuuaugaccaugauguauacagagacgaagcauuaaacaaccgguuccagaucaaagguguuaagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 31978 - RNA, 1701 nt, Artificial Sequence
  hemagglutinin__InfluenzaA__ABL67286
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaucgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31979 - RNA, 1701 nt, Artificial Sequence; identical to SEQ ID NO: 31509
  hemagglutinin__InfluenzaA__ABL67297

SEQ ID NO: 31980 - RNA, 1701 nt, Artificial Sequence
  hemagglutinin__InfluenzaA__ABL67308
augaagacuaucauugcuuugagcuacauuuuaugucugguuuucgcucaaaaacuucccggaaaugacaacagcauggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcagcuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaucaauuaaaauacaaauauccggcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauugacaaaugcaauucugaaugcaucacuccaaauggaagcauucccaaugacaaaccauuucaaaauguaaacaggaucacauaugggcucugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacguuaggugcaacauuugcauuuga

SEQ ID NO: 31981 - RNA, 1701 nt, Artificial Sequence; identical to SEQ ID NO: 31811
  hemagglutinin__InfluenzaA__ABL67319

SEQ ID NO: 31982 - RNA, 1701 nt, Artificial Sequence
  hemagglutinin__InfluenzaA__ABL67330
augaagacuaucauugcuuugagcuacauuuuaugccugguuuucgcucaaaaacuucccggaaaugacaacagcacggcaacgcugugccuggggcaucaugcggugccaaacggaacgcuagugaaaacaaucacgaaugaccaaauugaaguaacuaaugcuacugagcugguucagaguuccucaacagguagaauaugcgacaguccucaucaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcucugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguggaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 31983 - RNA, 1701 nt, Artificial Sequence; identical to SEQ ID NO: 31024
  hemagglutinin__InfluenzaA__ABL67341

SEQ ID NO: 31984 - RNA, 1701 nt, Artificial Sequence
  hemagglutinin__InfluenzaA__ABL67352
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugcuucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauuccaaaugacaaaccauuucaaaauguaaacaggaucacauauggggccugccccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31985 - RNA, 1701 nt, Artificial Sequence
  hemagglutinin__InfluenzaA__ABL67363
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31986 - RNA, 1701 nt, Artificial Sequence
  hemagglutinin__InfluenzaA__ABL67374
augaagacuaucauugcuuugagcuacauccuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaauugccucauccggcacacuggaguuuaacaaugaaagcuucaauuggacuggagucacucagaauggaacaagcucugcuugcaaaaggagaucuaaucaaaguuucuuuaguagauugaauugguugacccauuuaaaauucaaauacccagcauugaacgugacuaugccaaacaaugaaaaauuugacaaauuguacauuugggggguucaccacccggguacggacagugaccaaaucagccuauaugcucaagcaccaggaagaaucacagucucuaccaaaagaagccagcaaacuguaaucccgaauaucggaucuagacccaggguaagggauaucuccagcagaauaagcaucuauuggacaauaguaaaaccgggagacauacuuuugauuaacagcacagggaaucuaauugcuccucgggguuacuucaaaaugcgaagugggaaaagcucaauaaugaaaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaauugcggguuucauagaaaaugguugggagggaaugguggacgguugguacgguuucaggcaucagaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcgaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucaugucuuuugcuuuguguugcuuuguugggguucaucaugugggccugccaaaaaggcaacauuaggugcaacauuugcauuuga

SEQ ID NO: 31987 - RNA, 1701 nt, Artificial Sequence; identical to SEQ ID NO: 30826
  hemagglutinin__InfluenzaA__ABL67385

SEQ ID NO: 31988 - RNA, 1701 nt, Artificial Sequence
  hemagglutinin__InfluenzaA__ABL67396
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucagaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31989 - RNA, 1701 nt, Artificial Sequence
  hemagglutinin__InfluenzaA__ABL67407
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugugacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaaguauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31990 - RNA, 1701 nt, Artificial Sequence
  hemagglutinin__InfluenzaA__ABL67418
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacgcaagcagcaaucaaucaaaucaaugggaagcugaauagguugaucgggaagaccaacgagaaauuccaucagauugaaaaagaauucucagaaguagaagggagaauucaagaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 31991 - RNA, 1707 nt, Artificial Sequence
  hemagglutinin__InfluenzaA__ABL67781
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcaggauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuuugagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaaccuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 31992 - RNA, 1707 nt, Artificial Sequence
  hemagglutinin__InfluenzaA__ABL67794
auggagaaaauagugcuccuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagcuucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaacuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagaaaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaagcguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 31993 - RNA, 1707 nt, Artificial Sequence
  hemagglutinin__InfluenzaA__ABL67816
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuacucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuguugguacugugggggauucaccauccuaaugaugcggcagagcagacaaagcucuaucaaaacccaaccaccuauauuuccguugggacaucaacacuaaaccagagauugguaccaagaauagcuacuagauccaaagugaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguucuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauuaacaaaaugaacacucaguuugaggccguuggaagggaauuuaacaacuuagaaaggagaauagagaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 31994 - RNA, 1707 nt, Artificial Sequence
  hemagglutinin__InfluenzaA__ABL67827
auggagaaaauagugcuucuuuuugcaauagucagucuuguuaaaagugaucauauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuacucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagccucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaagugaacgggcaaaguggaaggauggaguucuucuggacaauuuuaaaaccgaaugaugcaaucaacuucgaaaguaauggaaauuucauugcuccagaauaugcauacgaaauugucaagaaaggggacucaacaauuaugaaaagugaauuggaauaugguaacugcaauaccaagugucaaacuccaaugggggcgauaaacucuaguaugccauuccacaauauacacccucucaccaucggggaaugccccaaauaugugaaaucaaacagauuaguucuugcgacugggcucagaaauagcccucaaauagagagaagaagaaaaaagagaggauuauuuggagcuauagcagguuuucuagagggaggauggcagggaaugguagaugguugguauggguaccaccauagcaaugagcaggggaguggguacgcugcagacaaagaauccacucaaaaggcaauagauggagucaccaauaaggucaacucgaucauuaacaaaaugaacacucaguuugaggccguuggaagggaauuuaacaacuuagaaaggagaauagagaauuuaaacaagaagauggaagauggguuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 31995 - RNA, 1701 nt, Artificial Sequence
  hemagglutinin__InfluenzaA__ABM22015
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcgacauuugcauuuga

SEQ ID NO: 31996 - RNA, 1701 nt, Artificial Sequence
  hemagglutinin__InfluenzaA__ABM22026
augaaagcaaaacuacuaguucuguugugugcauuuacagcuacauaugcagacacaauauguauaggcuaccaugcgaacaacucaacugacacuguugacacaguacuugagaagaacgugacagugacacacucugucaaccuacuugaggacagucacaacggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucaagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaagaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaacgcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaaaccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 31997 - RNA, 1701 nt, Artificial Sequence; identical to SEQ ID NO: 31137
  hemagglutinin__InfluenzaA__ABM22037

SEQ ID NO: 31998 - RNA, 1701 nt, Artificial Sequence; identical to SEQ ID NO: 31947
  hemagglutinin__InfluenzaA__ABM22059

SEQ ID NO: 31999 - RNA, 1701 nt, Artificial Sequence
  hemagglutinin__InfluenzaA__ABM22070
augaagacuaucauugcuuugagcuacauuuuaugccugguuuucgcucaaaaacuucccggaaaugacaacagcacggcaacgcugugccuggggcaucaugcggugccaaacggaacgcuagugaaaacaaucacgaaugaccaaauugagguaacuaaugcuacugagcugguucagaguuccucaacagguagaauaugcgacaguccucaucaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32000 - RNA, 1701 nt, Artificial Sequence
  hemagglutinin__InfluenzaA__ABM22081
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauauaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32001 - RNA, 1701 nt, Artificial Sequence
  hemagglutinin__InfluenzaA__ABM22092
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauugggcuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccgggcacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaauaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32002 - RNA, 1701 nt, Artificial Sequence
  hemagglutinin__InfluenzaA__ABM22103
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaaaugggaaaagcucaauaaugagaucagaugcacccauuggcaaaugcaauucugaaugcaucacaccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauauaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32003 - RNA, 1701 nt, Artificial Sequence; identical to SEQ ID NO: 31024
  hemagglutinin__InfluenzaA__ABM22114

SEQ ID NO: 32004 - RNA, 1701 nt, Artificial Sequence; identical to SEQ ID NO: 31959
  hemagglutinin__InfluenzaA__ABM22125

SEQ ID NO: 32005 - RNA, 1701 nt, Artificial Sequence
  hemagglutinin__InfluenzaA__ABM22136
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugugacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcccaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaaguauucccaaugacaaaccauuucaaaauguaaacaggaucacauauggggccugucccagauauguuaagcaaaacacucugaaauuggcaauagggaugcgaaauguaccagagaaacaaacuagaggcauauuuggcgcaauugcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32006 - RNA, 1701 nt, Artificial Sequence
  hemagglutinin__InfluenzaA__ABM22147
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucaaauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaaccagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32007 - RNA, 1701 nt, Artificial Sequence; identical to SEQ ID NO: 31425
  hemagglutinin__InfluenzaA__ABM22158

SEQ ID NO: 32008 - RNA, 1701 nt, Artificial Sequence
  hemagglutinin__InfluenzaA__ABM22169
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaaugggauuacaaacaaggugaacucuauaaucgagaaaaugaacacucaauucacagcuguggguaaagaauucaacaaacuagaaaaaaggauggaaaacuuaaauaaaaaaguugaugauggguuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32009 - RNA, 1701 nt, Artificial Sequence
  hemagglutinin__InfluenzaA__ABM22180
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccguccaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucagacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32010 - RNA, 1701 nt, Artificial Sequence
  hemagglutinin__InfluenzaA__ABM22191
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32011 - RNA, 1701 nt, Artificial Sequence
  hemagglutinin__InfluenzaA__ABM22202
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuauguaucuguagugucuucacauuauaacaggagauucaccccagaaauagcaaaaagacccaaaguaagaaaucaagaagggagaauuaauuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32012 - RNA, 1701 nt, Artificial Sequence
  hemagglutinin__InfluenzaA__ABM22213
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccguccaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32013 - RNA, 1701 nt, Artificial Sequence
  hemagglutinin__InfluenzaA__ABM22224
augaaagcaaaacuacugguccuguuaugugcacuuucagcuacagacgcagacacaauauguauaggcuaccaugcgaacaacucaaccgacacuguugacacagugcucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32014 - RNA, 1701 nt, Artificial Sequence
  hemagglutinin__InfluenzaA__ABM22235
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaagugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacauuccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32015 - RNA, 1701 nt, Artificial Sequence
  hemagglutinin__InfluenzaA__ABM22268
augaaaguaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucauguucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucgaacauaggggaccaaagggccaucuaucauacagaaaaugcuuaugucucuguagugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggcgucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32016 - RNA, 1701 nt, Artificial Sequence
  hemagglutinin__InfluenzaA__ABM22279
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagacacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugacugugacgcuaagugucaaacaccccaaggagcuauaaacaguagucuuccuuuccagaauguacacccagucacaauaggagggugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuaucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32017 - RNA, 1701 nt, Artificial Sequence
  hemagglutinin__InfluenzaA__ABM22290
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugagaacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaagaaagcucauggcccaaccacaccguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacauuccauccauucaaucuagagguuuguuuggagccauugccgguuucauugaagggggguggacuggaaugauagauggaugguaugguuaucaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagcgugaaaaauggaacuuaugacuauccaaaauauuccgaagaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32018 - RNA, 1701 nt, Artificial Sequence; identical to SEQ ID NO: 30762
  hemagglutinin__InfluenzaA__ABM22301

SEQ ID NO: 32019 - RNA, 1701 nt, Artificial Sequence; identical to SEQ ID NO: 30762
  hemagglutinin__InfluenzaA__ABM22312

SEQ ID NO: 32020 - RNA, 1701 nt, Artificial Sequence; identical to SEQ ID NO: 30762
  hemagglutinin__InfluenzaA__ABM22323

SEQ ID NO: 32021 - RNA, 1701 nt, Artificial Sequence; identical to SEQ ID NO: 30762
  hemagglutinin__InfluenzaA__ABM22334

SEQ ID NO: 32022 - RNA, 1701 nt, Artificial Sequence; identical to SEQ ID NO: 30763
  hemagglutinin__InfluenzaA__ABM22345

SEQ ID NO: 32023 - RNA, 1701 nt, Artificial Sequence; identical to SEQ ID NO: 30763
  hemagglutinin__InfluenzaA__ABM22356

SEQ ID NO: 32024 - RNA, 1701 nt, Artificial Sequence; identical to SEQ ID NO: 30783
  hemagglutinin__InfluenzaA__ABM22367

SEQ ID NO: 32025 - RNA, 1698 nt, Artificial Sequence; identical to SEQ ID NO: 31346
  hemagglutinin__InfluenzaA__ABM66864

SEQ ID NO: 32026 - RNA, 1701 nt, Artificial Sequence
  hemagglutinin__InfluenzaA__ABM66886
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaguucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32027 - RNA, 1701 nt, Artificial Sequence
  hemagglutinin__InfluenzaA__ABM66897
augaaagcaaaacuacugguccuguuaugugcacuuucagcuacagacgcagacacaauauguauaggcuaccaugcgaacaacucaaccgacacuguugacacagugcucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugagcucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32028 - RNA, 1701 nt, Artificial Sequence; identical to SEQ ID NO: 31425
  hemagglutinin__InfluenzaA__ABM66908

SEQ ID NO: 32029 - RNA, 1701 nt, Artificial Sequence; identical to SEQ ID NO: 30763
  hemagglutinin__InfluenzaA__ABM66919

SEQ ID NO: 32030 - RNA, 1701 nt, Artificial Sequence; identical to SEQ ID NO: 30763
  hemagglutinin__InfluenzaA__ABM66930

SEQ ID NO: 32031 - RNA, 1701 nt, Artificial Sequence; identical to SEQ ID NO: 30763
  hemagglutinin__InfluenzaA__ABM66941

SEQ ID NO: 32032 - RNA, 1701 nt, Artificial Sequence
  hemagglutinin__InfluenzaA__ABM66952
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccagguacggacaaugaccaaauuagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32033 - RNA, 1701 nt, Artificial Sequence; identical to SEQ ID NO: 32032
  hemagglutinin__InfluenzaA__ABM66963

SEQ ID NO: 32034 - RNA, 1701 nt, Artificial Sequence; identical to SEQ ID NO: 32032
  hemagglutinin__InfluenzaA__ABM66974

SEQ ID NO: 32035 - RNA, 1701 nt, Artificial Sequence; identical to SEQ ID NO: 32032
  hemagglutinin__InfluenzaA__ABM66985

SEQ ID NO: 32036 - RNA, 1701 nt, Artificial Sequence; identical to SEQ ID NO: 30783
  hemagglutinin__InfluenzaA__ABM66996

SEQ ID NO: 32037 - RNA, 1701 nt, Artificial Sequence; identical to SEQ ID NO: 30783
  hemagglutinin__InfluenzaA__ABM67007

SEQ ID NO: 32038 - RNA, 1701 nt, Artificial Sequence; identical to SEQ ID NO: 30783
  hemagglutinin__InfluenzaA__ABM67018

SEQ ID NO: 32039 - RNA, 1701 nt, Artificial Sequence
  hemagglutinin__InfluenzaA__ABM67029
augaagacuaucauugcuuugagcuacauuauaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaguugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaagggauauccccagcagaauaagcaucuauuggacaauaguaaaaccgggugacauacuuuugauuaacagcacagggaaucuaauugcuccuagggguuacuucagaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuauugggguucaucaugugggccugccaaaaaggcaacauuaggugcaacauuugcauuuga

SEQ ID NO: 32040 - RNA, 1698 nt, Artificial Sequence
  hemagglutinin__InfluenzaA__ABM67051
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaccacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguggaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32041 - RNA, 1707 nt, Artificial Sequence
  hemagglutinin__InfluenzaA__ABM90467
auggagaaaauagugcuucuucuuucaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaacguaccggaauggucuuacauaguggagaaggccaauccaaccaaugaccucuguuacccagggaguuucaacgacuaugaagaacugaaacaccuauugagcagaauaaaccauuuugagaaaauucagaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaauaaugaggcagagcagacaaggcuauaucaaaacccaaccaccuauauuuccauugggacaucaacacuaaaccagagauugguaccaaaaauagcuacuagauccaaaguaaacgggcaaaguggaaggauggaguuuuucuggacaauuuuaaaaccaaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggucuauuuggagcuauagcagguuuuauagagggaggauggcagggaaugguagaugguugguauggguaccaccauagcaaugagcaggggaguggguacgcugcagacaaagaaucuacucaaaaggcaauagauggagucaccaauaaggucaacucaauuauugacaaaaugaacacucaguuugaggccguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuaugacaagguccgacuacagcuuagggauaaugcaaaggagcuggguaacgguuguuucgaguucuaucacaaaugugauaaugaauguauggaaaguauaaggaacggaacguacaacuauccgcaguauucagaagaagcaagauuaaaaagagaggaaauaagugggguaaaguuggaaucaauaggaacuuaccaaauacugucaauuuacucaacaguggcgaguucccuagcacuggcaaucaugauagcuggucuaucuuuauggaugugcuccaauggaucguuacaaugcagaauuugcauuuaa

SEQ ID NO: 32042 - RNA, 1707 nt, Artificial Sequence
  hemagglutinin__InfluenzaA__ABM90511
auggagaaaauagugcuucuucuuucaauagucagucuuguuaaaagugaucagauuugcauugguuaccaugcaaacaauucaacagagcagguugacacaaucauagaaaaaaacguuacuguuacacaugcccaagacauacuggaaaagacacacaacgggaagcucugcgaucuagauggagugaagccucuaauuuuaaaagauuguaguguagcuggauggcuccucgggaacccaaugugugacgaauucaucaacguaccggaauggucuuacauaguggaaaaggccaauccaaccaaugaccucuguuacccagggaguuucaacgacuaugaagaacugaaacaccuauugagcagaauaaaccauuuugagaaaauucagaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaauaaugaggaagagcagacaaggcuauaucaaaacccaaccaccuauauuuccauugggacaucaacacuaaaccagagauugguaccaaaaauagcuacuagauccaaaguaaacgggcaaagugggaggauggaguucuucuggacaauuuuaaaaccaaaugaugcaaucaauuucgagagcaauggaaauuucauugcuccagaauaugcauacaaaauugucaagaaaggggacucagcaauuaugaagagugaauuggaauauaguaacugcaacaccaagugucaaacuccaaugggggcgauaaacucuaguaugccauuccacaacauacacccucucaccaucggggaaugccccaaauaugugaaaucaagcagauuaguccuugcaacagggcucagaaauagcccucaaagagagagcagaagaaaaaagagaggucuauuuggagcuauagcagguuuuauagagggaggauggcagggaaugguagaugguugguauggguaccaccauagcaaugagcaggggaguggguacgcugcagacaaagaaucuacucaaaaggcaauagauggagucaccaauaaggucaacucaauuauugacaaaaugaacacucaguuugaggccguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuaugacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaguuggaaucaauaggaacuuaccaaauacugucaauuuacucaacaguggcgaguucccuagcacuggcaaucaugauagcuggucuaucuuuauggaugugcuccaauggaucguuacaaugcagaauuugcauuuaa

SEQ ID NO: 32043 - RNA, 1707 nt, Artificial Sequence
  hemagglutinin__InfluenzaA__ABM90533
auggagaaaauagugcuucuucuuucaauagucagucuuguuaaaagugaucagauuugcauugguuaccaugcaaacaauucaacagagcagguugacacaaucauggaaaaaaacguuacuguuacacaugcccaagacauacuggaaaagacacacaacgggaagcucugcgaucuagauggagugaagccucuaauuuuaaaagauuguaguguagcuggauggcuccucgggaacccaaugugugacgaauucaucaacguaccggaauggucuuacauaguggaaaaggccaauccaaccaaugaccucuguuacccagggaguuucaacgacuaugaagaacugaaacaccuauugagcagaauaaaccauuuugagaaaauucagaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaauaaugaggaagagcagacaaggcuauaucaaaacccaaccaccuauauuuccauugggacaucaacacuaaaccagagauugguaccaaaaauagcuacuagauccaaaguaaacgggcaaagugggaggauggaguucuucuggacaauuuuaaaaccaaaugaugcaaucaauuucgagagcaauggaaauuucauugcuccagaauaugcauacaaaauugucaagaaaggggacucagcaauuaugaagagugaauuggaauauaguaacugcaacaccaagugucaaacuccaaugggggcgauaaacucuaguaugccauuccacaacauacacccucucaccaucggggaaugccccaaauaugugaaaucaagcagauuaguccuugcaacagggcucagaaauagcccucaaagagagagcagaagaaaaaagagaggucuauuuggagcuauagcagguuuuauagagggaggauggcagggaaugguagaugguugguauggguaccaccauagcaaugagcaggggaguggguacgcugcagacaaagaaucuacucaaaaggcaauagauggagucaccaauaaggucaacucaauuauugacaaaaugaacacucaguuugaggccguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuaugacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaguuggaaucaauaggaacuuaccaaauacugucaauuuacucaacaguggcgaguucccuagcacuggcaaucaugauagcuggucuaucuuuauggaugugcuccaauggaucguuacaaugcagaauuugcauuuaa

SEQ ID NO: 32044 - RNA, 1707 nt, Artificial Sequence; identical to SEQ ID NO: 32043
  hemagglutinin__InfluenzaA__ABM90544

SEQ ID NO: 32045 - RNA, 1701 nt, Artificial Sequence
  hemagglutinin__InfluenzaA__ABN50900
augaaagcaaaacugcugguccuguuaugugcacuuucagcuacagaugcagacacaauauguauaggcuaccaugcgaacaacucaaccgauacuguugacacaguacucgaaaagaacgugacagugacacacucugucaaccuacuugaggacagucacaacggaaaacuaugcagacuaaaaggaauagccccacuacaauuggggaaaugcagcauugccggguggaucuuaggaaacccagaaugugaaucacuguuuucuaagaaaucaugguccuacauugcagaaacaccaaacuccgagaaugggacauguuacccaggguauuucgccgacuaugaggaacugagggagcaauugaguucaguaucaucauucgagagauucgaaauauuccccaaggaaaguucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacagaagauucaccccagaaauagcaaaacgacccaaaguaagaggucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaauacgucaggaguacaaaauuaaggauggucacaggacuaaggaacauuccauccauucaauccagagguuuguuuggagccauugccgguuucauugaagggggauggacuggaaugauagauggaugguaugguuaucaucaucagaaugaacagggauccggcuaugcugcagaucaaaaaagcacacaaaaugccauuaacgggauuacaaacaaggugaacucuguuaucgagaaaaugaacacucaauucacagcuguagguaaagaauucaacaaauuagaaaaaaggauggaaaacuuaaauaaaaaaguugaugauggguuucuggacauuuggacauauaaugcagaauuguugguucuacuggaaaaugaaaggacuuuggauuuucaugacucaaaugugaagaaccuguaugagaagguaaaaagccaauuaaagaauaaugccaaagaaauaggaaacggguguuuugaauucuaccacaaguguaacaaugaaugcauggagaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32046 - RNA, 1701 nt, Artificial Sequence; identical to SEQ ID NO: 31425
  hemagglutinin__InfluenzaA__ABN50917

SEQ ID NO: 32047 - RNA, 1701 nt, Artificial Sequence
  hemagglutinin__InfluenzaA__ABN50928
augaaagcaaaacuacuaauccuguuaugugcauuuacagcuacagaugcagacacaauauguauaggcuaccaugcgaacaacucaaccgacacuguugacacaguacuugaaaagaacgugacagugacacacucugucaaccuacuugaggacagucacaacggaaaacuaugucgacuaaaaggaauagccccacuacaauuggguaauugcagcauugccggauggauuuuaggaaacccagaaugcgaaucacuguuuucuaagaaaucaugguccuacauugcagaaacaccaaacuccgagaauggaacauguuacccaggguauuucgccgacuaugaggaacugagagagcaauugaguucaguaucaucauucgagagauucgaaauauuccccaaagaaagcucauggcccaaccacaccguaaccaaaggaguaacggcaucaugcucccauaaggggaaaagcaguuuuuacagaaauuugcuauggcugacggagaagaauggcucguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauaacaggagauucaccccagaaauagcaaaaagacccaaaguaagaggucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaagaaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaacaaugccaaagaaauaggaaacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 32048 - RNA, 1701 nt, Artificial Sequence
  hemagglutinin__InfluenzaA__ABN50940
augaaagcaaaacuacuaguccuguuaugugcauucacagcuacagaugcagacacaauauguauaggcuaccaugcgaacaacucaaccgacacuguugacacaguacuugaaaagaacgugacagugacacacucugucaaccuacuugaggacagucacaacggaaaacuaugucgacuaaaaggaauagccccacuacaauuggguaauugcaguauugccggauggauuuuaggaaacccagaaugcgaaucacuguuuucuaagaaaucaugguccuacauugcagaaacaccaaacuccgagaauggaacauguuacccaggguauuucucugacuaugaggaacugagggagcaauugaguucaguaucaucauucgagagauucgaaauauuccccaaagaaagcucauggcccaaccacaccguaaccaaaggaguaacggcaucaugcucccauaaggggaaaagcaguuuuuacagaaauuugcuauggcugacggagaagaauggcucguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauaacaggagauucaccccagaaauagcaaaaagacccaaaguaagagaucaagaaggaagaauuaacuacuacuggacucugcuggaacccgaggacacaauaauauuugaggcaaauggaaaucuaauagcgccaugguaugcuuuugcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaagaaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggguuucuggacauuuggacauauaaugcagaauuguugguucuacuggaaaaugaaaggacuuuggauuuucaugacucaaaugugaagaaucuguaugagaaaguaaaaagccaauuaaagaacaaugccaaagaaauaggaaacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 32049 - RNA, 1701 nt, Artificial Sequence
  hemagglutinin__InfluenzaA__ABN50951
augaaaguaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggagucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacaccguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguagugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagaccaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaacagggaaaaaauugauggagugaaauuggaaucaaugggcgucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32050 - RNA, 1701 nt, Artificial Sequence
  hemagglutinin__InfluenzaA__ABN50962
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggauaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32051 - RNA, 1701 nt, Artificial Sequence
  hemagglutinin__InfluenzaA__ABN50973
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccacaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucaggaaucaucaccucaaacgcaucaaugggugacugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32052 - RNA, 1701 nt, Artificial Sequence; identical to SEQ ID NO: 30762
  hemagglutinin__InfluenzaA__ABN50984

SEQ ID NO: 32053 - RNA, 1701 nt, Artificial Sequence; identical to SEQ ID NO: 30763
  hemagglutinin__InfluenzaA__ABN50995

SEQ ID NO: 32054 - RNA, 1701 nt, Artificial Sequence
  hemagglutinin__InfluenzaA__ABN51043
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuucuuguaugcucaagcaucaggaagaaucacagucucuaccaaaagaagccaacaaacuguaaucccgaauaucggauccagaccuagaguaagggauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32055 - RNA, 1701 nt, Artificial Sequence
  hemagglutinin__InfluenzaA__ABN51054
augaagacuaucauugcuuugagcuacauucuaugucugguuuucgcucaaaaacuucccggaaaugacaacagcacggcaacgcugugccuugggcaccaugcaguaccaaacggaacgauagugagaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaaggagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32056 - RNA, 1701 nt, Artificial Sequence
  hemagglutinin__InfluenzaA__ABN51066
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaagaaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaaggaccaucuaucauacagaaaaugcuuaugucucuguggugucuucacauuauagcagaagguucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucaaugggugacugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauagaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucgguuucuggauguguucuaaugggucuuugcaguguagaauaugcaucuga

SEQ ID NO: 32057 - RNA, 1698 nt, Artificial Sequence
  hemagglutinin__InfluenzaA__ABN51077
augaaagcaaaacuacugguccuguuauguacauuuacagcuacauacgcagacacaauauguauaggcuaccaugccaacaacucaacagacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucagggaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacgaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32058 - RNA, 1698 nt, Artificial Sequence
  hemagglutinin__InfluenzaA__ABN51088
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccauaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagauaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaggggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32059 - RNA, 1701 nt, Artificial Sequence
  hemagglutinin__InfluenzaA__ABN51099
augaagaccaucauugcuuugagcuacauuuucugucuggcucucggccaagaccuuccaggaaaugacaacagcacagcaacgcugugccugggacaucaugcggugccaaacggaacacuagugaaaacaauaacaaaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggugcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacagaguaaucgagaagaugaacgagaaauuccaucaaaucgaaaaggaauucucagaaguagaagggagaauucaggaccucgagaaauacguugaagacacuaaaauagaucucuggucuuacaaugcggaacuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32060 - RNA, 1701 nt, Artificial Sequence
  hemagglutinin__InfluenzaA__ABN51110
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauaaacugcacacugauagaugcucuauugggggacccucauugugauguuuuucaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaagaaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32061 - RNA, 1701 nt, Artificial Sequence
  hemagglutinin__InfluenzaA__ABN51121
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauaaacugcacacugauagaugcucuauugggggacccucauugugauguuuuucaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauuaauagcaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggaacaugccccaaguauguuaagcaaaacacccugaaguuggcaacagggaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacuuggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32062 - RNA, 1701 nt, Artificial Sequence
  hemagglutinin__InfluenzaA__ABN51132
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauaaacugcacacugauagaugcucuauugggggacccucauugugauguuuuucaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaucuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32063 - RNA, 1698 nt, Artificial Sequence
  hemagglutinin__InfluenzaA__ABN51143
augaaagcaaaacuacugguccuguuauguacauuuacagccacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuuacuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacuuauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32064 - RNA, 1701 nt, Artificial Sequence
  hemagglutinin__InfluenzaA__ABN51154
augaagacuaucauugcuuugagcuacauuuuaugucugguuuucacucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccuggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuuuaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32065 - RNA, 1701 nt, Artificial Sequence
  hemagglutinin__InfluenzaA__ABN59390
augaagacuaucauugcuuugagcuacauuauaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaguugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggugacauacuuuugauuaacagcacagggaaucuaauugcuccuagggguuacuucagaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuauugggguucaucaugugggccugccaaaaaggcaacauuaggugcaacauuugcauuuga

SEQ ID NO: 32066 - RNA, 1701 nt, Artificial Sequence
  hemagglutinin__InfluenzaA__ABN59401
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacucgaggacagccacaacgggaaacuaugcagacuaaaaggaauagccccacuacaauuggggaaaugcaacauugccggauggaucuuaggaaacccagaaugcgaaucacuguuuucuaagaaaucaugguccuacauugcagaaacaccaaacucugagaauggaacauguuacccaggauauuucgccgacuaugaggaacugagggagcaauugagcucaguaucaucauucgagagauucgaaauauuccccaaggaaaggucauggcccaaacacaacauaaccagaggaguaacggcagcaugcucccauaaggggaaaagcaguuuuuacagaaauuugcuauggcugacggagaaaaauggcucguacccaaaucugaacaaguccuaugugaacaauaaagagaaagaaguccuuguacuaugggguguucaucacccgucuaacauagaggaccaaaagacccucuaucggaaagaaaaugcuuaugucucuguagugucuucaaauuauaacaggagauucaccccagaaauagcagaaagacccaaaguaagaggucaagcagggagaauuaacuacuacuggacucugcuggaacccggggacacaauaauauuugaggcaaauggaaaucuaauagcgccauggcaugcuuucgcacugaguagaggcuuugggucaggaaucaucaccucaaacgcaucgauggaugaaugugacacgaagugucaaacaccccagggagcuauaaacaguagucucccuuuccagaauauacacccagucacaauaggagagugcccaaaauacgucaggaguacaaaauugaggaugguuacaggacuaaggaacaucccauccauucaauccagaggucuguuuggggccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggauguuuugaauucuaccacaaguguaacaaugaaugcauggaaaguguaaaaaauggaacuuaugauuauccaaaauauucagaggaaucaaaguuaaacagggaaaaaauugauggagugaaauuggaaucaaugggagucuaucagauucuggcgaucuacucaacugucgccaguucacuggugcuucuggucucccugggggcaaucagcuucuggauguguucuaaugggucuuugcagugcagaauaugcaucuga

SEQ ID NO: 32067 - RNA, 1698 nt, Artificial Sequence
  hemagglutinin__InfluenzaA__ABN59412
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaagcugaaaaauucuuaugugaacaaaaaagggaaagaaguccuuguacugugggguauucaucacccgccuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggaauuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 32068 - RNA, 1701 nt, Artificial Sequence
  hemagglutinin__InfluenzaA__ABN59423
augaaagcaaaacuacugguccuguuaugugcacuuucagcuacagaugcagacacaauauguauaggcuaccaugcgaacaacucaaccgacacuguugacacagugcucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagagaaccaaaagaccaucuaucggaaagaaaaugcuuaugucucuguagugucuucaaauuauaacaggagauucaccccagaaauagcagaaagacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagucuuccuuuccagaauguacacccagucacaauaggagagugcccaaaauacgucaggaguacaaaauuaaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuagugcuuuuggucucccugggggcaaucagcuucuggauguguucuaaugggucuuugcagugcagaauaugcaucuga

SEQ ID NO: 32069 - RNA, 1701 nt, Artificial Sequence
  hemagglutinin__InfluenzaA__ABO32656
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccccaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaucacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcggguuucauagaaaaugguugggaaggaaugguggacgguugguacgguuucaggcaucaaaauucugagggcacaggacaagcagcagaucuuaaaagcacucaagcugcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32070 - RNA, 1701 nt, Artificial Sequence
  hemagglutinin__InfluenzaA__ABO32667
augaagacuaucauugcuuugagcuacauuuuaugucugguuuucgcucaaaaacuucccggaaaugacaacagcacggcaacgcugugccuggggcaccaugcaguaccaaacggaacgcuagugaaaacaaucacgaaugaccaaauugaagugacuaaugcuacugagcugguucagaguuccucaacagguggaauaugcgacaguccccaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgggaaaacgaacgagaaauuccaucagauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32071 - RNA, 1698 nt, Artificial Sequence
  hemagglutinin__InfluenzaA__ABO32678
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaagucuuaugcaaacaacaaagaaaaagaaguccuuguacuaugggguguucaucacccgccuaacauaggggaccaaagggcucucuaucauacagaaaaugcuuaugucucuguagugucuucacauuauagcagaagauucaccccagaaauagccaaaagacccaaggugagagaucaggaaggaagaaucaacuacuacuggacacugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcaaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugaaaaaaugaacacucaauucacagcugugggcaaagaauucagcaaauuggagagaaggauggaaaacuuacauaaaaaaguugaugauggguuucuagacauuuggacauauaaugcagaauuguugguucuacuggaaaaugaaaggacuuuggauuuccacgacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32072 - RNA, 1701 nt, Artificial Sequence
  hemagglutinin__InfluenzaA__ABO32692
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32073 - RNA, 1701 nt, Artificial Sequence; identical to SEQ ID NO: 31937
  hemagglutinin__InfluenzaA__ABO32751

SEQ ID NO: 32074 - RNA, 1701 nt, Artificial Sequence; identical to SEQ ID NO: 31937
  hemagglutinin__InfluenzaA__ABO32762

SEQ ID NO: 32075 - RNA, 1701 nt, Artificial Sequence; identical to SEQ ID NO: 31959
  hemagglutinin__InfluenzaA__ABO32775

SEQ ID NO: 32076 - RNA, 1701 nt, Artificial Sequence; identical to SEQ ID NO: 30822
  hemagglutinin__InfluenzaA__ABO32790

SEQ ID NO: 32077 - RNA, 1701 nt, Artificial Sequence
  hemagglutinin__InfluenzaA__ABO32803
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacacacuuuugauuaacagcacagggaaucuaauugcuccucgggguuacuucaaaauacgaagugggaaaagcucaauaaugagaucagaugcacccauugacaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggauucaucaugugggccugccaaaaaggcaacauuaggugcaacauuugcauuuga

SEQ ID NO: 32078 - RNA, 1701 nt, Artificial Sequence; identical to SEQ ID NO: 31161
  hemagglutinin__InfluenzaA__ABO32816

SEQ ID NO: 32079 - RNA, 1701 nt, Artificial Sequence; identical to SEQ ID NO: 30783
  hemagglutinin__InfluenzaA__ABO32827

SEQ ID NO: 32080 - RNA, 1701 nt, Artificial Sequence
  hemagglutinin__InfluenzaA__ABO32838
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagagaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32081 - RNA, 1701 nt, Artificial Sequence; identical to SEQ ID NO: 32080
  hemagglutinin__InfluenzaA__ABO32849

SEQ ID NO: 32082 - RNA, 1701 nt, Artificial Sequence
  hemagglutinin__InfluenzaA__ABO32860
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagagaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaagggauauccccagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32083 - RNA, 1701 nt, Artificial Sequence; identical to SEQ ID NO: 32065
  hemagglutinin__InfluenzaA__ABO32871

SEQ ID NO: 32084 - RNA, 1701 nt, Artificial Sequence
  hemagglutinin__InfluenzaA__ABO32882
augaagacuaucauugcuuugagcuacauuauaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaguugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggugacauacuuuugauuaacagcacagggaaucuaauugcuccuagggguuacuucagaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuauugggguucaucaugugggccugccaaaaaggcaacauuaggugcaacauuugcauuuga

SEQ ID NO: 32085 - RNA, 1701 nt, Artificial Sequence
  hemagglutinin__InfluenzaA__ABO32893
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuucuuguaugcucaagcaucaggaagaaucacagucucuaccaaaagaagccaacaaacuguaaucccgaauaucggauccagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32086 - RNA, 1701 nt, Artificial Sequence; identical to SEQ ID NO: 32085
  hemagglutinin__InfluenzaA__ABO32904

SEQ ID NO: 32087 - RNA, 1701 nt, Artificial Sequence; identical to SEQ ID NO: 32055
  hemagglutinin__InfluenzaA__ABO32915

SEQ ID NO: 32088 - RNA, 1701 nt, Artificial Sequence; identical to SEQ ID NO: 32055
  hemagglutinin__InfluenzaA__ABO32926

SEQ ID NO: 32089 - RNA, 1701 nt, Artificial Sequence
  hemagglutinin__InfluenzaA__ABO32937
augaagacuaucauugcuuugagcuacauucuaugucugguuuucgcucaaaaacuucccggaaaugacaacagcacggcaacgcugugccuugggcaccaugcaguaccaaacggaacgauagugagaacaaucacgaaugaccaaauugaaguuacuaaugcuacugagcugguucagaguuccucaacaggugaaauaugcgacagcccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucuucuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaaggagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32090 - RNA, 1698 nt, Artificial Sequence
  hemagglutinin__InfluenzaA__ABO32948
augagagcaaaacuacugguccuguuauguacauuuacagcuacauacgcagacacaauauguauaggcuaccaugccaacaacucaaccgacacuguugacacaguacuugagaagaaugugacagugacacauucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaaugggacauguuacccaggauauuucgccgacuaugaggaacugagggagcaauugaguucaguaucuucauuugagagauucgaaauauuccccaaaggaagcucauggcccaaccacacuguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucgaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaccaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32091 - RNA, 1698 nt, Artificial Sequence
  hemagglutinin__InfluenzaA__ABO32959
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgcugacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcagguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacauuaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccaguuacaauaggagaguguccaaaguaugucaggaguacaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaauguagaauaugcaucuga

SEQ ID NO: 32092 - RNA, 1698 nt, Artificial Sequence; identical to SEQ ID NO: 31888
  hemagglutinin__InfluenzaA__ABO32970

SEQ ID NO: 32093 - RNA, 1701 nt, Artificial Sequence
  hemagglutinin__InfluenzaA__ABO32981
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguccuaugggguguucaucacccgucuaacauaaaggaccaaaagaccaucuaucggaaagaaaaugcuuaugucucuguagugucuucaaauuauaacaggagauucaccccagaaauagcagaaagacccaaaguaagagaucaagcagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagucuuccuuuccagaauguacacccagucacaauaggagagugcccaaaauacgucaggaguacaaaauuaaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32094 - RNA, 1701 nt, Artificial Sequence
  hemagglutinin__InfluenzaA__ABO32992
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacgacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauaucagaaagacccaaaguaagagaucaaaaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagucuuccuuuccagaauguacacccagucacaauaggagagugcccaaaauacgucaggaguacaaaauuaaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32095 - RNA, 1701 nt, Artificial Sequence
  hemagglutinin__InfluenzaA__ABO33006
augaaagcaaaaauacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugugaaucacuguuuucuaagaaaucuugguccuacauugcagaaacaccaaacuccgagaauggaacauguuacccaggauauuucgcugacuaugaggaacugagggagcaauugaguucagugucaucauucgagagauucgaaauauuccccaaggaaaggucauggcccaaacacaacguaaccaggggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauaucaaaaagacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagucuuccuuuccagaauguacacccagucacaauaggagagugcccaaaauacgucaggaguacaaaauuaaggaugguuacaggacuaaggaacaucccaucuauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaagaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccuuggggcaaucagcuucuggauguguucuaaugggucuuugcagugcagaauaugcaucuga

SEQ ID NO: 32096 - RNA, 1701 nt, Artificial Sequence
  hemagglutinin__InfluenzaA__ABO33025
augaaagcaaaacuacugguccuguuaugugcacucucagcuacagaugcagacacaauauguauaggcuaccaugcgaacaacucaaccgacacuguugacacaguacucgaaaagaacgugacagugacacacucugucaaccuacuugaggacaaucacaacgggaaacuaugcaaacuaaaaggaauagcgccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaagaacugagggaacaauugaguucaguaucaucauucgagagauucgaaauauuccccaaggaaaguucauggcccaaccacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauaaaggaccaaaggaccaucuaucguaaagaaaaugcuuaugucucuguagugucuucacauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaagugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaauuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32097 - RNA, 1701 nt, Artificial Sequence
  hemagglutinin__InfluenzaA__ABO33036
augaagacuaucauugcuuugagcuacauuuuaugucugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcaacaguccucaccaaauccuugauggagaaaacugcacacuaauagaugcucuauugggagacccucauugugauggcuuccaaaauaaggaaugggaccuuuuuguugaacgcagaaaagccuacagcaacuguuacccuuaugaugugccggauuaugccucccuuaggucacuaguugccucaucuggcacacuggaguuuaacaaugaaagcuucaacuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuguaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32098 - RNA, 1701 nt, Artificial Sequence; identical to SEQ ID NO: 31875
  hemagglutinin__InfluenzaA__ABO33047

SEQ ID NO: 32099 - RNA, 1701 nt, Artificial Sequence
  hemagglutinin__InfluenzaA__ABO33058
augaagacuaucauugcuuugagcuacauuuuaugucugguuuucgcucaaaaacuucccggaaaugacaacagcacggcaacgcugugccuggggcaucaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 32100 - RNA, 1701 nt, Artificial Sequence
  hemagglutinin__InfluenzaA__ABO33069
augaagacuaucauugcuuugagcuacauuuucugucugguuuucgcccaaaaccuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaucgaauccuugauggaaaaaacugcacacugauagaugcucuauugggagacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuaucaaugaaggcuucaauuggacuggggucacucagaauggaggaagcuaugcuugcaaaaggggaccugauaacaguuucuucaguagacugaacugguuguacgaaucagaaagcaaauauccagugcugaacgugacuaugccaaacaaugacaauuuugacaaacuguacauuugggggguucaccacccgagcacggacaaagaacaaaccaaccuauauguucaagcaucagggagagucacagucucuaccaagaaaagccagcagacuauaaucccgaaugucgggucuagacccuggguaaggggucugucuaguagaauaaguaucuauuggacaauaguaaaaccgggagacauacuguuaauuaauaguaaugggaaccuaauugcuccucgggguuacuucaaaauacgcacugggaaaagcucaauaaugaggucagaugcaccuauuggcaccugcaguucugaaugcaucacuccaaauggaagcauucccaaugacaagcccuuucaaaacguaaacaagaucacauauggagcaugucccaaguauguuaagcaaaacacucugaaguuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagccaucgaccaaaucaaugggaaacugaauaggguaaucgagaaaacgaacgagaaauuccaucaaaucgaaaaggaauucucagaaguagaagggagaauucaggaccucgagaaauacauugaagacacuaaaauagaucucuggucuuacaaugcggagcuucuugucgcuuuggagaaccaacauacaauugaucugacugacucgaaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 32101 - RNA, 1701 nt, Artificial Sequence
  hemagglutinin__InfluenzaA__ABO37988
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacgggaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagaaaucaagaagggagaauuaacuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggguuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32102 - RNA, 1701 nt, Artificial Sequence
  hemagglutinin__InfluenzaA__ABO38010
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuuuuuucuaaggaaucaugguccuacauugcagaaacaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcguugggucaggaaucaucaccucaaacgcaucaaugggugacugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32103 - RNA, 1698 nt, Artificial Sequence
  hemagglutinin__InfluenzaA__ABO38021
augaaagcaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauucccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaucccagaaauggccaaaagacccaaaguaagagaucaggaaggaagaaucaacuacuacuggacucugcuggaacccggagauacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaccacaagugcaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32104 - RNA, 1698 nt, Artificial Sequence
  hemagglutinin__InfluenzaA__ABO38032
augaaaguaaaacuacugguccugcuauguacauuuacagcuacauaugcagacacaauauguauaggcuaccaugccaacaacucaaccgacacuguugacacagugcuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccagauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccuaagggagcuauaaacagcagucuuccuuuccagaaugugcacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuccuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggaaucuaucagauucuggcgaucuacucaacugucgccaguuccuugguucuuuuggucucccugggggcaaucagcuucuggauguguuccaaugggucuuugcaguguagaauaugcaucuga

SEQ ID NO: 32105 - RNA, 1698 nt, Artificial Sequence
  hemagglutinin__InfluenzaA__ABO38043
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccaucaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32106 - RNA, 1701 nt, Artificial Sequence
  hemagglutinin__InfluenzaA__ABO38054
augaaagcaagacuacugguccuguuaugugcacuugcagcuacagaugcagacacaauauguauaggcuaccaugcaaacaacucaaccgacacuguugacacaguacucgaaaagaaugugacagugacacacucugucaaccuacucgaagacagccacaacgggaaauuauguagauuaaaaggaauagccccacuacaauuggggaaauguaacauugccggauggaucuugggaaacccagaaugcgaaucacugcuuucagagagaucaugguccuacauuguagaaacaccaaacucugaaaauggaacauguuacccaggagauuucaucgacuaugaggaacugagggagcaauugagcucaguaucaucauucgaaagauucgaaauauucuccaaggaaagcucauggcccaaacacaacacaaccagaggaguaacggcagcaugcucccaugcgggaaaaaguaguuuuuacagaaauuugcuauggcugacggagaaggauggcucauacccgaaucugaacaauuccuaugugaacaagaaagggaaagaaguccuuguacuaugggguguucaucacccgucuaacauaaaggaucaacagacccucuaucagaaagaaaaugcuuaugucucuguagugucuucaaacuauaacaggagauucaccccggaaauagcagaaagacccaaaguaagaggucaagcagggaggaugaacuauuacuggaccuugcuaaaacccggagacacaauaauguuugaggcaaauggaaaucuaauagcgccaugguaugcuuucgcacuaaguagaggcuuugggucaggcaucaucaccucaaacgcaucgaugcaugagugugacacgaagugucaaacaccccagggagcuauaaacagcagucucccuuuccagaauauacacccagucacaauaggagagugcccaaaauacgucaggaguaccaaauugaggaugguuacaggacuaaggaacaucccauccauucaauccagaggucuauuuggagccauugccgguuucauugaagggggauggacuggaaugauagauggaugguaugguuaucaucaucagaaugaacagggaucaggcuaugcugcggaucaaaaaagcacacaaaaugccauuaacgggauuacaaacaaggugaacucuguuaucgagaaaaugaacacucaauucacagcuguggguaaagaauucaacaacuuagaaaaaaggauggaaaacuuaaacaaaaaaguugaugauggauuucuggacauuuggacauauaaugcagaauuguugguucuacuggaaaaugaaaggacucuggauuuccaugacucaaaugugaagaaucuguaugaaaaaguaaaaaaccaauuaaggaauaaugccaaagaaauaggaaacggauguuuugaguucuaccacaaguguaacaaugaaugcauggaaaguguaaaaaauggaacuuaugauuauccaaaauauucagaagaaucaaaguugaacagggaaaaaauagauggagugaaauuggaaucaaugggggucuaucagauucuggcgaucuacucaacugucgccaguucacuggugcuucuggucucccugggggcaaucagcuucuggauguguucuaaugggucuuugcagugcagaauaugcaucuga

SEQ ID NO: 32107 - RNA, 1701 nt, Artificial Sequence
  hemagglutinin__InfluenzaA__ABO38065
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacauaaccagaggaguaacggcaucaugcucccauaaggggaaaagcaguuuuuacagaaacuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcaaaaagacccaaaguaagaggucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagucuuccuuuccagaauguacacccagucacaauaggagagugcccaaaauacgucaggaguacaaaauuaaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggaugugcucuaaugggucuuugcagugcagaauaugcaucuga

SEQ ID NO: 32108 - RNA, 1701 nt, Artificial Sequence
  hemagglutinin__InfluenzaA__ABO38076
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuucaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcacuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32109 - RNA, 1701 nt, Artificial Sequence
  hemagglutinin__InfluenzaA__ABO38087
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacggguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaaguggaaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaggggaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggaugugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32110 - RNA, 1689 nt, Artificial Sequence
  hemagglutinin__InfluenzaA__ABO38098
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacaaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcggacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32111 - RNA, 1701 nt, Artificial Sequence
  hemagglutinin__InfluenzaA__ABO38230
augaagacuaucauugcuuugagcuacauuuucugucagguuuucgcccaaaaccuuccaggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaauccucaucgaauccuugauggaaaaaacugcacacugauagaugcucuauugggggacccucauugugauggcuuucaaaaugagaaaugggaccuuuuuguugaacgcagcaaagcuuucagcaacuguuacccuuaugaugugccagauuaugccucccuuaggucacuaguugccucgucaggcacccuggaguuuuucaaugaaggcuucaauuggacuggggucacucagaaugggggaagcuaugcuuguaaaaggggaccugauaacaguuucuucaguagacugaacugguuguacaaaucagaaagcacauauccagugcugaacgugacuaugccaaacaaugacaauuuugacaaacuguacauuuggggaguucaccacccgagcacggacaaagaacaaaccaaccuauauguucaagcaucagggagagucacagucuccaccaagagaagccagcaaacuauaaucccgagugucgggucuagacccuggguaaggggucugucuaguagaauaagcaucuauuggacaauagugaaaccgggagacguacuguuaauuaauaguaaugggaaccuaauugcuccucgggguuacuucaaaauacgcacugggaaaagcucaauaaugaggucagaugcacccauuggcaccugcaguucugaaugcaucacuccaaauggaagcauucccaaugacaagcccuuucaaaacguagacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaaaacaaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 32112 - RNA, 1701 nt, Artificial Sequence
  hemagglutinin__InfluenzaA__ABO38241
augaagacuaucauugcuuugagcuacauuuccugucugguuuucgcccaaaaacuucccggaaaugacaacagcacagcaacgcugugccugggacaucaugcaguaccaaacggaacgcuagugaaaacaaucacgaaugaucagauugaagugacuaaugcuacugagcugguccaaaguuccucaacagguagaauaugcgacaguccucaccgaauccuugauggaaaaaacugcacacugauagaugcucuauugggagacccucauugugauggcuuccaaaaugagaaaugggaucuuuuuguugaacgcagcaaagcuuucagcaacugcuacccuuaugaugugccggauuaugccucccuuaggucacuaguugccucaucaggcacccuggaguuuaucaaugaaggcuucaauuggacuggagucacucagagugggggaagcuauacuugcaaaaggggaucuguuaacaguuucuucaguagauugaauugguuguaugagucagaaagcaaauauccagcgcugaacgugacuaugccaaacaauggcaaauuugacaaauuguacauuugggggguucaccacccuagcacggacaaagaacaaaccaaccuauauguucgagcaucagggagagucacagucucuaccaagaggagccagcaaacuguaaucccgaauaucgggccuagacccuggguaaggggucugucuaguagaauaaguaucuauuggacaauaguaaaaccgggagacauacuguuaauuaauagcacugggaaccuaauugcuccccgggguuacuucaaaauacgcacugggaaaagcucaauaaugaggucagaugcaccuauuggcaccugcaguucuggaugcaucacuccaaauggaagcauucccaaugacaaacccuuucaaaaugugaacaagaucacauauggggcaugucccagguauguuaagcagaacacucugaaguuggcaacagggaugcggaauguaccugaaaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaguauguugaagacacuaaaauagaucucuggucuuacaacgcggagcuucuuguugcccuggagaaccaacauacaauugauaugacugacucagaaaugaacaaacuguuugaaaaaacaaggaagcaacugagggaaaaugcugaggacaugggcaaugguugcuucaaaauauaccacaaaugugacaaugcuugcauagggucaaucagaaauggaacuuaugaccaugauguauacagagacgaagcauuaaacaaccgguuucagaucaaagguguugagcugaagucaggauacaaagacuggauccuauggauuuccuuugccauaucaugcuuuuugcucuguguuguuuugcugggguucauaaugugggccugccaaaaaggcaacauuaggugcaacauuugcauuuga

SEQ ID NO: 32113 - RNA, 1701 nt, Artificial Sequence
  hemagglutinin__InfluenzaA__ABO38252
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacgaacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugucaaaaaggcaacauuaggugcaacauuugcauuuga

SEQ ID NO: 32114 - RNA, 1689 nt, Artificial Sequence
  hemagglutinin__InfluenzaA__ABO38296
auggucaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacauuuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggaaaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcuaagagacaacgccaaagaacuaggaaauggauguuuugaauuuuaucacaaaugugaugaugaaugcaugaauagugugaaaaacgggacguauuauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32115 - RNA, 1698 nt, Artificial Sequence
  hemagglutinin__InfluenzaA__ABO38318
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccgugaccggaguaucagcaucaugcucccauaaugggaaaagcaguuuuuacagaaauuuacuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32116 - RNA, 1698 nt, Artificial Sequence; identical to SEQ ID NO: 31304
  hemagglutinin__InfluenzaA__ABO38329

SEQ ID NO: 32117 - RNA, 1701 nt, Artificial Sequence
  hemagglutinin__InfluenzaA__ABO38351
augaaggcaagacuacugguccuguuaugugcacuugcagcuacagaugcagacacaauauguauaggcuaccaugcgaacaauucaaccgacacuguugacacaguacucgagaagaaugugacagugacacacucuguuaaccugcucgaagacagccacaacgggaaauuauguagauuaaaaggaauagccccacuacaauuggggaaauguaacaucgccggauggcucuugggaaacccagaaugcgacccacugcuuccagcgagaucaugguccuacauuguagaaacaccaaacucugagaauggaauauguuauccaggagcuuucaucgacuaugaggaacugagggagcaauugagcucagugucaucauucgaaagauucgaaauauuucccaaagaaagcucauggcccaaccacaacacaaacauaggaguaacggcagcaugcucccaugcggggaaaagcaguuuuuacagaaauuugcuauggcugacgaagaaggggggcucauacccaaagcugaaaaauuccuaugugaacaaaaaagggaaagaaguccuuguacuaugggguauucaucacccgucuaacaguaaggaucaacagacucucuaucagaaugaaaaugcuuaugucucuguagugucuucaaauuauaacaggagauucaccccggaaauagcagaaagacccgaaguaagagaucaagcugggaggaugaacuauuacuggaccuugcuagaacccggagacacaauaauguuugaggcaaauggaaaucugguagcaccaugguaugcuuucgcacugaguagaggcuuuggguccggcaucaucaccucaaacgcaucaaugcaugaguguaacacgaagugucaaacaccccagggagcuauaaacagcagucucccuuuccagaauauacacccagucacaauaggagagugcccaaaauacgucaggagugccaaauugaggaugguuacaggacuaaggaacaucccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacucuguuaucgagaaaaugaacacucaauucacagcuguggguaaagaauucaacaacuuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaauugaacagggaaaagauagauggagugaaauuggaaucaaugggggucuaucagauucuggcgaucuacucaacugucgccaguucacuggugcuuuuggucucccugggggcaaucaguuucuggauguguucuaauggaucuuugcagugcagaauaugcaucuga

SEQ ID NO: 32118 - RNA, 1701 nt, Artificial Sequence
  hemagglutinin__InfluenzaA__ABO38362
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacugguuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaggaaaguucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagagaaccaaaagaccaucuaucguaaagaaaaugcuuaugucucuguagugucuucacauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauagaugaaugugacgcgaagugucaaacaccccagggagcuauaaacaguagucuuccuuuccagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguaaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32119 - RNA, 1698 nt, Artificial Sequence
  hemagglutinin__InfluenzaA__ABO38373
augaaagcaagacuacugguccuguuaugugcacuugcagcuacagaugcagacacaauauguauaggcuaccaugcaaacaacucaaccgacacuguugacacaguacucgaaaagaaugugacagugacacacucugucaaccuacucgaagacagccacaacgggaaauuauguagauuaaaaggaauagccccacuacaauuggggaaauguaacauugccggauggaucuugggaaacccagaaugcgaaucacugcuuucagagagaucaugguccuacauuguagaaacaccaaacucugaaaauggaacauguuacccaggagauuucaucgacuaugaggaacugagggagcaauugagcucaguaucaucauucgaaagauucgaaauauucuccaaggaaagcucauggcccaaacacacaaccggaggaguaacggcagcaugcucccaugcgggaaaaaguaguuuuuacagaaauuugcuauggcugacggagaaggauggcucauacccgaaucugaacaauuccuaugugaacaagaaagggaaagaaguccuuguacuaugggguguucaucacccgucuaacauaaaggaucaacagacccucuaucagaaagaaaaugcuuaugucucuguagugucuucaaacuauaacaggagauucaccccggaaauagcagaaagacccaaaguaagaggucaagcagggaggauaaacuauuacuggaccuugcuaaaacccggagacacaauaauguuugaggcaaauggaaaucuaauagcgccaugguaugcuuucgcacuaaguagaggcuuugggucaggcaucaucaccucaaacgcaucgaugcaugagugugacacgaagugucaaacaccccagggagcuauaaacagcagucucccuuuccagaauauacacccagucacaauaggagagugcccaaaauacgucaggaguaccaaauugaggaugguuacaggacuaaggaacaucccauccauucaauccagaggucuauuuggagccauugccgguuucauugaagggggauggacuggaaugauagauggaugguaugguuaucaucaucagaaugaacagggaucaggcuaugcugcggaucaaaaaagcacacaaaaugccauuaacgggauuacaaacaaggugaacucuguuaucgagaaaaugaacacucaauucacagcuguggguaaagaauucaacaacuuagaaaaaaggauggaaaacuuaaacaaaaaaguugaugauggauuucuggacauuuggacauauaaugcagaauuguugguucuacuggaaaaugaaaggacucuggauuuccaugacucaaaugugaagaaucuguaugaaaaaguaaaaaaccaauuaaggaauaaugccaaagaaauaggaaacggauguuuugaguucuaccacaaguguaacaaugaaugcauggaaaguguaaaaaauggaacuuaugauuauccaaaauauucagaagaaucaaaguugaacagggaaaaaauagauggagugaaauuggaaucaaugggggucuaucagauucuggcgaucuacucaacugccgccaguucccuggugcuucuagucucccugggggcaaucagcuucuggauguguucuaaugggucuuugcagugcagaauaugcaucuga

SEQ ID NO: 32120 - RNA, 1701 nt, Artificial Sequence
  hemagglutinin__InfluenzaA__ABO38384
augaaggcaagacuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacgggaaacuauguagauuaaaaggaauacccccacuacaauuggggaaauguaacaucgccggauggcucuugggaaacccagaaugcgacucacugcuuccagcgagaucaugguccuacauuguagaaacaccaaacucugagaauggagcauguuauccaggagauuucaucaacuaugaggaacugagggagcaauugagcucagugucaucauuugaaagauucgaaauauuucccaaggaaagcucauggcccaaacacaacacaaccaaaggaguaacggcggcaugcucccaugcgggaaaaagcaguuuuuacagaaauuugcuauggcugacgaagaaggaggacucauacccaaagcugaaaaauuccuaugugaacaagaaagggaaagaaguccuuguacuaugggguguucaucacccgucuagcaguaaggagcaacagacucucuaucagaaugaaaaugcuuaugucucuguagugucuucaaauuauaacaggagauucaccccggaaauagcagaaagacccaaaguaagagaucaaacugggaggaugaacuauuacuggaccuugcuagaacccggagacacaauaauauuugaggcaaauggaaaucuaauagcaccaugguaugcuuucgcacugaguagaggcuuuggguccggcaucaucaccucaaacgcaucaaugcaugaguguaacacgaagugucaaacaccccagggagcuauaaacagcagucucccuuuccagaauauacacccagucacaauaggagagugcccaaaauacgucaggagugccaaauugaggaugguuacaggacuaaggaacaucccauccauucaauccagaggucuauuuggagccauugccggguuuauugaagggggauggacuggaaugauagauggaugguaugguuaucaucaucagaaugaacagggaucaggcuaugcagcagaucaaaaaagcacacaaaaugccauuaacgggauuacaaacaaggugaacucuguuaucgagaaaaugaacacucaauucacagcuguggguaaagaauucaacaacuuagaaaaaaggauggaaaauuuaaauaaaaaaguugaugauggauuucuggacauuuggacauauaaugcagaauuauuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagauagauggagugaaauuggaaucaaugggggucuaucagauucuggcgaucuacucaacugucgccaguucacuggugcuuuuggucucccugggggcaaucaguuucuggauguguucuaauggaucuuugcagugcagaauaugcaucuga

SEQ ID NO: 32121 - RNA, 1701 nt, Artificial Sequence
  hemagglutinin__InfluenzaA__ABO38395
augaaagcaaaacuacuaguccuguuaugugcauuuacagcuacagaugcagacaccauauguauaggcuaccaugcgaacaacucaaccgacacuguugacacaguacuugaaaagaacgugacagugacacacucugucaaccuacuugaggacagucacaacggaaaacuaugucgacuaaaaggaauagccccacuacaauuggguaauugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcaucaugcucccauaaggggagaagcaguuuuuacagaaauuugcuauggcugacgaagaagaauggcucguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauaacaggagauucaccccagaaauagcaaaaagacccaaaguaagagaucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaagugugaaaaauggaacuuaugacuauccaaaauauuccgaggaaucaaaauuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 32122 - RNA, 1701 nt, Artificial Sequence
  hemagglutinin__InfluenzaA__ABO38406
augaaagcaaaacuacugguccuguuaugugcacucucagcuacagaugcagacacaauauguauaggcuaccaugcgaacaacucaaccgacacuguugacacaguacucgaaaagaacgugacagugacacacucugucaaccuacuugaggacaaucacaacgggaaacuaugcaaacuaaaaggaauagcgccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaagaacugagggaacaauugaguucaguaucaucauucgagagauucgaaauauuucccaaggaaaguucauggcccaaccacaacguaaccaaaggaguaacggcaucaugcucccauaaggggaaaagcaguuuuuacagaaauuugcuauggcugacggagaaaaaaggcucguacccaaaucugagcaaauccuaugugaacaacaaagagaaagaaguccuuguacuaugggguauucaucacccgucuaacauagaggaccaaaagaccaucuaucguaaagaaaaugcuuaugucucuguagugucuucacauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguaggggcuuugggucaggaaucaucaccucaaacgcaucgauggaugaaugugacgcgaagugucaaacaccccggggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagcuauugccgguuucauugaagggggauggacuggaaugauugauggaugguaugguuaucaucaucagaaugaacagggaucuggcuaugcugcggaucaaaaaagcacacaaagugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccacgacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaauuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32123 - RNA, 1701 nt, Artificial Sequence
  hemagglutinin__InfluenzaA__ABO38417
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccccaacagguagaauaugcgacaguccucaccaaauccuugauggagaaaacugcacacuaauagaugcucuguugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaucacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaauacacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaauugcggguuucauagaaaaugguugggaaggaaugguggacgguugguacgguuucaggcaucaaaauucugagggcacaggacaagcagcagaucuuaaaagcacucaagcugcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32124 - RNA, 1689 nt, Artificial Sequence
  hemagglutinin__InfluenzaA__ABO38712
auggccaucauuuauuucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccucagcagcguaaaacacuucgagaaaguaaggauucugcccaaagauggauggacacaacauacaacaucuggagguucaaaggccugcgcagugucagguaaaucaucauucuucaggaacauggucuggcugacaaagaaaggaccaaauuauccgguugccaaaagaucguacaacaauacgagcggagagcaaaugcuaauaauuuggggagugcaccauccuaaagaugaggcagaacaaagagcauuguaccagaaagugggaaccuauguuuccgcaagcacaucaacauugaacaaaaggucaaccccagaaauagcagcaaggccugaagugaauggacuaggaaguagaauggaauucucuuggacccuauuggaugugugggacaccauaaauuuugagagcacugguaaucuaguugcaccagaguauggauucaaaauaucgaaaagagguaguucaggaaucaugaagacagaaggaacacuuggaaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccucagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacacucaauuugaagcuguugggaaagaauucaguaacuuagagaaaagacuggaaaacuugaacaaaaagauggaagacggguuucuagauguguggacauacaaugcugagcuucuaguucugauggaaaaugagaggacacuugacuuucaugauucuaaugucaagaaccuguauaauaaagucagaaugcagcugagagacaacgucaaagaacuaggaaauggauguuuugaauuuuaucacaaaugugacgaugaaugcaugaguagugugaaaaacgggacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugauagcugggaucucuuuauggaugugcuccaacgggucucugcagugcagaaucugcauauga

SEQ ID NO: 32125 - RNA, 1689 nt, Artificial Sequence
  hemagglutinin__InfluenzaA__ABO38723
auggccaucauuuauuucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccucagcagcguaaaacacuucgagaaaguaaggauucugcccaaagauggauggacacaacauacaacaucuggagguucaaaggccugcgcagugucagguaaaucaucauucuucaggaacauggucuggcugacaaagaaaggaccaaauuauccgguugccaaaagaucguacaacaauacgagcggagagcaaaugcuaauaauuuggggagugcaccauccuaaugaugaggcagaacaaagagcauuguaccagaaagugggaaccuauguuuccgcaagcacaucaacauugaacaaaaggucaaccccagaaauagcagcaaggccugaagugaauggacuaggaaguagaauggaauucucuuggacccuauuggaugugugggacaccauaaauuuugagagcacugguaaucuaguugcaccagaguauggauucaaaauaucgaaaagagguaguucaggaaucaugaagacagaaggaacacuuggaaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccucagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacacucaauuugaagcuguugggaaagaauucaguaacuuagagaaaagacugggaaacuugaacaaaaagauggaagacggguuucuagauguguggacauacaaugcugagcuucuaguucugauggaaaaugagaggacacuugacuuucaugauucuaaugucaagaaccuguauaauaaagucagaaugcagcugagagacaacgucaaagaacuaggaaauggauguuuugaauuuuaucacaaaugugacgaugaaugcaugaguagugugaaaaacgggacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugauagcugggaucucuuuauggaugugcuccaacgggucucugcagugcagaaucugcauauga

SEQ ID NO: 32126 - RNA, 1698 nt, Artificial Sequence
  hemagglutinin__InfluenzaA__ABO44046
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaagaugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32127 - RNA, 1689 nt, Artificial Sequence
  hemagglutinin__InfluenzaA__ABO44057
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccuaaguagcguaaaacacuucgagaaaguaaagauucugccaaaagauggauggacacagcaugagacagauggagguucaaaggccugcgcagugucagguaaagcaucauucuucaggaacauggucuggcugacaaagagaggaccaaauuaucagguugccaaaagaucguacaacaauacgagcggagagcaaaugcuaauaauuuggggagugcaccauccuaaggaugaggcagaacaaagagcauuguaccagaaagugggaaccuauguuuccgcaagcacaucaacauugaacaaaaggucaaccccagaaauagcagcaaggccugaagugaauggacuagagaguagaauggaauucucuuggacccucuuggaugugugggacaccauaaauuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacauccaauuugaagcuguugggaaagaauucaguaacuuagagaaaagacuggaaaacuugaacaaaaagauggaagacggguuucuagauguguggacauacaaugcugagcuucuaguucugauggaaaaugagaggacacuugacuuucaugauucuaaugucaagaaccuguaugauaaagucagaaugcagcugagagacaacgucaaagaacuaggaaauggauguuuugaauuuuaucauaaaugugacgaugaaugcaugaauagugugaaaaaugggacauaugauuaucccaaguaugaagaagaaucuaagcuaaagagaaaugaaaucaaagggguaaaauugagcagcauggggguuuaccaaauucuugccauuuaugcuacaguugcagguucucugucauuggcaaucaugauagcugggaucucuuucuggauguguuccaacgggucucugcagugcagagucugcauauga

SEQ ID NO: 32128 - RNA, 1701 nt, Artificial Sequence; identical to SEQ ID NO: 32032
  hemagglutinin__InfluenzaA__ABO44079

SEQ ID NO: 32129 - RNA, 1689 nt, Artificial Sequence
  hemagglutinin__InfluenzaA__ABO44090
auggccaucauuuaucucauucuccuguucacagcagugagaggggaccaaauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagagugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacaugaucuggcugacaaagaaaggaucaaauuauccgguugccaaaggaucguacaacaacacaagcggagaacaaaugcuaauaauuugggggguacaccaucccaaugaugagacagaacaaagaacauuguaccagaaugugggaaccuauguuuccguagucacaucaacauugaacaaaaggucaaccccgaaaauagcaacaaggccuaaagugaauggacuaggagguagaauggaauucucuuggacccuauuggauaugugggacaccauaaauuuugagaguacugguaaucuaauugcuccagaguauggauucaaaauaucgaaaagaggcaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaagggcauuugauggaaucacuaacaagguaaauucugugauugaaaagaugaacacccaauuugaagcuguuggaaaagaauucaguaacuuagagagaagacuggagaacuugaacaaaaagauggaagacgggcuucuagauguguggacauacaaugcugagcuucuaguucugauggaaaaugagaggauacuugacuuucaugauucuaaugucaagaaucuguaugauaaagucagaaugcagcugagagacaacgucaaagaacuaggaaauggauguuuugaauuuuaucacaaaugugaugaugagugcaugaauagugugaaaaacgggacguaugauuaucccaaguaugaagaagagucuaaacuaaauagaaaugaaaucaaagggguaaaauuaagcagcauggggguuuaucaaauccuugccauuuaugcuacaguagcagguucucugucacuggcaaucaugauggcugggaucucuuucuggaugugcuccaacgggucccugcagugcaggaucugcauauga

SEQ ID NO: 32130 - RNA, 1689 nt, Artificial Sequence
  hemagglutinin__InfluenzaA__ABO44101
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaauuccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccucaguagcguaaaacacuucgagaaaguaaagauucugccaaaagauggauggacacagcauaagacagauggagguucaaaggccugcgcagugucagguaaaccaucauucuucaggaacauggucuggcugacaaagaaaggaccuaauuauccgguugccaaaagaucguacaacaauacgagcggagagcaaaugcuaauaauuuggggagugcaccauccuaaugaugaggcagaacaaagagcauuguaccagaaagugggaaccuauguuuccgcaagcacaucaacauugaacaaaaggucaaccccagaaauagcagcaaggccugaagugaguggacuaggaaguagaauggaauucucuuggacccucuuggaugugugggacaccauaaguuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacacccaauuugaagcuguugggaaagaauucaguaacuuagagaaaagacuggaaaacuugaacaaaaagauggaagacggguuucuagauguguggacauacaaugcugagcuucuaguucugauggaaaaugagaggacacuugacuuucaugauucuaaugucaagaaccuguaugauaaagucagaaugcagcugagagacaacgucaaagaacuaggaaauggauguuuugaauuuuaucauaaaugugacgaugaaugcaugaauagugugaaaaaugggacguaugauuaucccaaguaugaagaagaaucuaaacuaaagagaaaugaaaucaaaggggugaaauugagcagcauggggguuuaccaaauucuugccauuuaugcuacaguugcagguucucugucacuggcaaucaugauagcugggaucucuuucuggaugugcuccaacgggucucugcagugcagaaucugcauauga

SEQ ID NO: 32131 - RNA, 1701 nt, Artificial Sequence
  hemagglutinin__InfluenzaA__ABO44123
augaaagcaaaacuacuaguccuguuaugugcauuuacagcuacagaugcagacacaauauguauaggcuaccaugcgaacaacucaaccgacacuguugacacaguacuugaaaagaacgugacagugacacacucugucaaccuacuugaggacagucacaacggaaaacuaugucgacuaaaaggaauagccccacuacaauuggguaauugcagcauugccggauggauuuuaggaaacccagaaugcgaaucacuguuuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcaucaugcucccauaaggggaaaagcaguuuuuacagaaauuugcuauggcugacgaagaagaauggcucguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauaacaggagauucaccccagaaauagcaaaaagacccaaaguaagagaucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaagaaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaacaaugccaaagaaauaggaaacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 32132 - RNA, 1701 nt, Artificial Sequence
  hemagglutinin__InfluenzaA__ABO44134
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacucgaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugagcucaguaucaucauucgagagauucgaaauauuccccaaggaaaggucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcagaaagacccaaaguaagaggucaagcagggagaauuaacuacuacuggacucugcuggaacccggggacacaauaauauuugaggcaaauggaaaucuaauagcgccauggcaugcuuucgcacugaguagaggcuuugggucaggaaucaucaccucaaacgcaucgauggaugaaugugacacgaagugucaaacaccccagggagcuauaaacaguagucuuccuuuccagaauauacacccagucacaauaggagagugcccaaaauacgucaggaguacaaaauugaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcagaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucaaauucuggcgaucuacucaacugucgccaguucacuggugcuuuuggucucccugggggcaaucagcuucuggauguguucuaaugggucuuugcagugcagaauaugcaucuga

SEQ ID NO: 32133 - RNA, 1701 nt, Artificial Sequence
  hemagglutinin__InfluenzaA__ABO52071
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccgaguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32134 - RNA, 1701 nt, Artificial Sequence
  hemagglutinin__InfluenzaA__ABO52225
augaaagcaaaacuacuaguccuguugugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaacaccaaacccugagaauggaacauguuacccaggguauuucgccgacuaugaggaacugaaggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacggaaaagaauggcuuguacccaaaucugagcaaguccuauguaaacaacaaggagaaagaaguccuuguacuaugggguguucaucauccgucuaacauaggggaccaaagggccaucuaucauacagaaaaugcuuauguuucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcauugaguagaggcuuugggucagggaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacgaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32135 - RNA, 1689 nt, Artificial Sequence
  hemagglutinin__InfluenzaA__ABO52236
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacauuuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggaaaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcuaagagacaacgccaaagaacuaggaaauggauguuuugaauuuuaucacaaaugugaugaugaaugcaugaauagugugaaaaacgggacguauuauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32136 - RNA, 1689 nt, Artificial Sequence
  hemagglutinin__InfluenzaA__ABO52247
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaauuccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccucaguagcguaaaacacuucgagaaaguaaagauucugccaaaagauggauggacacagcauaagacagauggagguucaaaggccugcgcagugucagguaaaccaucauucuucaggaacauggucuggcugacaaagaaaggaccuaauuauccgguugccaaaagaucguacaacaauacgagcggagagcaaaugcuaauaauuuggggagugcaccauccuaaugaugaggcagaacaaagagcauuguaccagaaagugggaaccuauguuuccgcaagcacaucaacauugaacaaaaggucaaccccagaaauagcagcaaggccugaagugaguggacuaggaaguagaauggaauucucuuggacccucuuggaugugugggacaccauaaguuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggaccaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacacccaauuugaagcuguugggaaagaauucaguaacuuagagaaaagacuggaaaacuugaacaaaaagauggaagacggguuucuagauguguggacauacaaugcugagcuucuaguucugauggaaaaugagaggacacuugacuuucaugauucuaaugucaagaaccuguaugauaaagucagaaugcagcugagagacaacgucaaagaacuaggaaauggauguuuugaauuuuaucauaaaugugacgaugaaugcaugaauagugugaaaaaugggacguaugauuaucccaaguaugaagaagaaucuaaacuaaagagaaaugaaaucaaaggggugaaauugagcagcauggggguuuaccaaauucuugccauuuaugcuacaguugcagguucucugucacuggcaaucaugauagcugggaucucuuucuggaugugcuccaacgggucucugcagugcagaaucugcauauga

SEQ ID NO: 32137 - RNA, 1701 nt, Artificial Sequence
  hemagglutinin__InfluenzaA__ABO52258
augaaagcaaaacuacugguccuguuaugugcacuuucagcuacagaugcagacacaauauguauaggcuaccaugcgaacaauucaaccgacacuguugacacgguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaagaacugagggagcaauugaguucaguaucaucauucgagagauucgaaauauuccccaaggaaaguucauggcccaaacacaacguaaccagaggaguaacggcuucaugcucccauaaggggaaaugcaguuuuuacagaaauuugcuauggcugacggagaaaaauggcucguacccaaaucugagcaaauccuaugugaacaacaaagagaaagaaguccuuguacuaugggguguucaucacccgucuaacauagaggaccaaaagaccaucuaucguaaagaaaaugcuuaugucucuguagugucuucacauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguagaggauuugggucaggaaucaucaccucaaacgcaucgauggaugaaugugacgcgaagugucaaacaccccagggagcuauaaacaguagucuuccuuuccagaauguacacccagucacaauaggagagugcccaaaauacgucaggaguacaaaauuacggaugguuacaggacuaaggaacaucccauccauucaauccagagguuuguuuggagccauugccgguuucauugaagggggauggacuggaaugauagauggaugguaugguuaucaucaucagaaugaacagggaucuggcuaugcugcagaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32138 - RNA, 1701 nt, Artificial Sequence
  hemagglutinin__InfluenzaA__ABO52280
augaaagcaagacuacugauccuguuaugugcacuuucagcuacagaugcagacacaauauguauaggcuaccaugcgaacaauucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuugggaaacccagaaugcgaaucauugcucucuaauagaucaugguccuacauugcagaaacaccaaacucugagaauggaauauguuacccaggagauuucgccgacuaugaggaacugagggagcaauugagcucaguaucaucauucgagagauucgaaauauuccccaaggaaagcucauggcccaaacacaacauaaccagaggaguaacgguagcaugcucccacgcgaagaaaagcaguuuuuacaaaaauuugcucuggcugacggaggcaaauggcuuauacccaagucugagcaaguccuaugugaacgacagagagaaagaaguccuugugcuaugggguguucaucacccgucuaacauagaggaucaaaggacccucuaucggaaagaaaaugcuuaugucucuguggugucuucaaauuauaacaggagauucaccccggaaauagcagaaagacccaaaguaagaggucaaccagggagaaugaacuauuacuggacuuugcuagaacccggagacaaaauaauauuugaggcaaauggaaaccuaauagcgccaugguaugcuuucgcacugaguagaggcccuggaucaggaaucaucaccuccaacgcaucaauggaugaaugugacacgaagugucaaacaccccagggagccauaaacaguagccucccuuuucagaacauacacccagucacaauaggagagugcccaaaauaugucaggaguaccaaauugaggaugguuacaggacuaaggaacaucccauccauucaauccagaggucuguuuggagccauugccgguuucauugaagggggauggacuggaaugguggauggaugguaugguuaccaucaucagaaugagcagggaucuggcuaugcugcggaccaaaaaagcacacaaaaugccauuaacgggauuacaaauaaggugaacucuguuaucgagaaaaugaacacucaauucacagcuguggguaaagaguucaacaaauuggaaaaaagaauggaaaacuuaaauaaaaaaguugaugauggauuucuggacauuuggacauauaaugcagaauuauugguucuacuggaaaaugaaaggacuuuggauuuccaugacucaaaugugaagaaucuguaugagaaaguaaaaaaccaauugagaaauaaugcaaaggaaauaggaaacggguguuuugaguucuaccacaagugugacaaugaaugcauggaaaguguaaaaaauggaacuuaugauuacccaaaguauucagaggaaucaaaguuaaacagggcaaaaauugauggaguaaaacuggaaucaaugggggucuaucagauucuggcgaucuacucaacugucgccaguucacuggugcuucuggucucccugggggcaaucagcuuuuggauguguuccaaugggucuuugcaaugcagaauaugcaucuga

SEQ ID NO: 32139 - RNA, 1689 nt, Artificial Sequence
  hemagglutinin__InfluenzaA__ABO52302
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuagggaacuguagcauugccggauggcuccuuggaaauccagaaugugauaggcuucuaagugugccagaaugguccuauauaauggagaaagaaaacccgagagacgguuuguguuauccaggcagcuucaacgauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggauuuaucaaauccuugccauuuaugcuacaguagcagguucucugucacuggcaaucaugauggcugggaucucuuucuggaugugcuccaacgggucucugcagugcaggaucugcauauga

SEQ ID NO: 32140 - RNA, 1701 nt, Artificial Sequence
  hemagglutinin__InfluenzaA__ABO52313
augaagacuaucauugcuuugagcuacauuuucugucugguuuucgcccaaaaccuuccaggaaaugacaacagcacagcaacgcugugccugggacaucaugcggugccaaacggaacgcuagugaaaacaaucacgaaugaucagauugaagugacuaaugcuacugagcugguucagagcuccucaacggguaaaauaugcaacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagacuaugccucccuuaggucacuaguugccucgucaggcacucuggaguuuaucaaugaaggcuucaauuggacuggggucacucagaaugggggaagcaaugcuugcaaaaggggaccugauagcgguuuuuucaguagacugaacugguuguacaaaucaggaagcacauauccagugcugaacgugacuaugccaaacaaugacaauuuugacaaacuauacauuugggggguucaccacccgagcacggaccaagaacaaaccaaccuauauguucaagcaucagggagagucacagucuccaccaagagaagccagcaaacuauaaucccgaauguugggucuagacccuggguaaggggucugucuaguagaauaagcaucuauuggacaauaguuaaaccgggagacauacugguaauuaauaguaaugggaaccuaauugcuccucggggucacuucaaaaugcgcacugggaagagcucaauaaugaggucagaugcaccuauuggcaccugcaguucugaaugcaucacuccaaauggaagcauucccaaugacaagcccuuucaaaacguaaacaagaucacauauggggcaugucccaaguacgucaagcaaaacacucugaaguuggcaacagggaugcggaauguaccagagaaacaaacuagaggcauauucggcgcaauagcagguuucauagaaaaugguugggagggaaugauagacgguugguacgguuucaggcaucgaaauucugagggcacaggacaagcagcagaucuuaaaagcacucaagcagcuaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccaaaaaggcaacauuaggugcaacauuugcauuuga

SEQ ID NO: 32141 - RNA, 1701 nt, Artificial Sequence
  hemagglutinin__InfluenzaA__ABO52335
augaagacuaucauugcuuugagcuacauuuucugucugguucucggccaagacuuuccaagaaaugacaacagcacagcaacgcugugccugggacaucaugcggugccaaacggaacacuagugaaaacaaucacaaaugaucagauugaagugacuaaugcuacugagcugguucagaguuccucaacggggaaaauaugcaacaauccucaucgaauccucgauggaauagacugcacacugauagaugcucuauugggggacccucauugugauggcuuucaaaaugagacaugggaccuuuucguugaacgcagcaaagcuuucagcaacuguuacccuuaugaugugccagauuaugccucccuuaggucacuaguugccucgucuggcacucuggaguuuaucaaugaaggcuucacuuggacuggggucacucagaaugggggaagcaaugcuugcaaaaggggaccugauagcgguuuuuucaguagacugaacugguuguacaaaucaggaaacacauauccaguacugaacgugacuaugccaaacaaugacaauuuugacaaacuauacauuugggggguucaccacccgagcacggaccaagaccaaaccagccuauauguucaagcaucagggagagucacagucuccacuaagagaagccagcaaacuguaaucccgaauaucgggccuagacccuggguaaggggucugucuaguagaauaagcaucuauuggacaauaguuaaaccgggagacauacuguuaauuaauaguaaugggaaccuaauugcuccucgggguuauuucaaaaugcgcacugggaaaagcucaauaaugaggucagaugcaccuauuggcaccugcauuucugaaugcaucacuccaaauggaagcauucccaaugacaagcccuuucaaaacguaaacaagaucacauauggggcauguccuaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacagggcaagcagcagaucuuaaaagcacucaagcagccaucgaccaaaucaauggaaaacugaauaggguaaucgagaagacgaacgagaaauuccaucaaaucgaaaaggaguucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacagaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 32142 - RNA, 1701 nt, Artificial Sequence
  hemagglutinin__InfluenzaA__ABO52346
augaagacuaucauugcuuugagcuacauuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcgacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaagagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacaggaaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 32143 - RNA, 1701 nt, Artificial Sequence
  hemagglutinin__InfluenzaA__ABO52357
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaaccauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuuuugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugauaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32144 - RNA, 1701 nt, Artificial Sequence
  hemagglutinin__InfluenzaA__ABO52368
augaagaccaucauugcuuugagcuacauuuucugucuggcucucggccaagaccuuccaggaaaugacaacaguacagcaacgcugugccugggacaucaugcggugccaaacggaacacuagugaaaacaaucacaaaugaucagauugaagugacuaaugcuacugagcuaguucagaguuccucaacggggaaaauaugcaacaauccucaucgaauccuugauggaauaaacugcacacugauagacgcucuauugggggacccucauugugauguuuuccaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaaaccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaauuggcaacagggaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacagaguaaucgagaagacgaacgagaaauuccaucaaaucgaaaaggaauucucugaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32145 - RNA, 1701 nt, Artificial Sequence
  hemagglutinin__InfluenzaA__ABO52797
augaaagcaaaacuacugguccuguuaugugcacucucagcuacagaugcagacacaauauguauaggcuaccaugcgaacaacucaaccgacacuguugacacaguacucgaaaagaacgugacagugacacacucugucaaccuacuugaggacaaucacaacgggaaacuaugcaaacuaaaaggaauagcgccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaagaacugagggaacaauugaguucaguaucaucauucgagagauucgaaauauuccccaaggaaaguucauggcccaaccacaacguaaccaaaggaguaacggcaucaugcucccauaaggggaaaagcaguuuuuacagaaauuugcuauggcugacggagaaaaauggcucguacccaagucugagcaaguccuaugugaacaacaaagagaaagaaguccuuguacuaugggguguucaucacccgucuaacauaaaggaccaaaagaccaucuaucguaaagaaaaugcuuaugucucuguagugucuucacauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacguaaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaagugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaauuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32146 - RNA, 1698 nt, Artificial Sequence; identical to SEQ ID NO: 31246
  hemagglutinin__InfluenzaA__ABP49217

SEQ ID NO: 32147 - RNA, 1698 nt, Artificial Sequence
  hemagglutinin__InfluenzaA__ABP49305
augaaagcaaaacuaaugguccuguuauguacauuuacagcuacauaugcagacacaauauguaucggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaacugcagcguugccggauggaucuuaggaaacccagaaugcgaauuacugauuuccaaggaaucaugguccuacauuguagaaacaccaaauccugaaaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaaugggugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32148 - RNA, 1701 nt, Artificial Sequence
  hemagglutinin__InfluenzaA__ABP49316
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacucgaggacagccacaacgggaaacuaugcagacuaaaaggaauagccccacuacaauuggggaaaugcaacauugccggauggaucuuaggaaacccagaaugcgaaucacuguuuucuaagaaaucaugguccuacauugcagaaacaccaaacucugagaauggaacauguuacccaggauauuucgccgacuaugaggaacugagggagcaauugagcucaguaucaucauucgagagauucgaaauauuccccaaggaaaggucauggcccaaacacaacauaaccagaggaguaacggcagcaugcucccauaaggggaaaagcaguuuuuacagaaauuugcuauggcugacggagaaaaauggcucguacccaaaucugaaaaaguccuaugugaacaauaaagagaaagaaguccuuguacuaugggguguucaucacccgucuaacauagaggaccaaaagacccucuaucggaaagaaaaugcuuaugucucuguagugucuucaaauuauaacaagagauucaccccagaaauagcagaaagacccaaaguaagaggucaagcagggagaauuaacuacuacuggacucugcuggaacccggagacacaauaauauuugaggcaaauggaaaucuaauagcgccauggcaugcuuucgcacugaguagaggcuuugggucaggaaucaucaccucaaacgcaucgauggaugaaugugacacgaagugucaaacaccccagggagcuauaaacaguagucucccuuuccagaauauacacccagucacaauaggagagugcccaaaauacgucaggaguacaaaauugaggaugguuacaggacuaaggaacaucccauccauucaauccagaggucuguuuggggccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugauuauccaaaauauucagaggaaucaaaguuaaacagggaaaaaauugauggagugaaauuggaaucaaugggagucuaucagauucuggcgaucuacucaacugucgccaguucacuggugcuucuggucucccugggggcaaucagcuucuggauguguucuaaugggucuuugcagugcagaauaugcaucuga

SEQ ID NO: 32149 - RNA, 1701 nt, Artificial Sequence
  hemagglutinin__InfluenzaA__ABP49327
augaaggcaagacuacugguccuguuaugugcacuugcagcuacagaugcagacacaauauguauaggcuaccaugcgaacaacucaaccgauacuguugacacaguacucgaaaagaaugugacagugacacacucugucaaccuacucgaagacagccacaacgggaaauuauguagauuaaaaggaauagccccacuacaauugaggaaauguaacauugcuggauggauccugggaaacccagaaugcgaaucacugcuuucagagagaucaugguccuacauuguugaaacaccaaacucugagaauggaacauguuacccaggagauuuuaccaacuaugaggaacugagggagcaauugagcucuguaucaucauucgaaagauucgaaauauuccccaaggaaagcucauggcccaaacacaacacaaccagaggaguaacggcagcaugcucccaugcgggaaaaagcaguuuuuacagaaauuugcuauggcugacggagaaggauggcucauauccgaaucugaacaauuccuaugugaacaagaaagggaaagaaguccuuguacuaugggguguucaucacccguccaacauaaaggaucaacagacccucuaucagaaagaaaaugcuuaugucucuguagugucuucaaacuauaacaggagauucaccccggaaauagcagaaagacccaaaguaagaggucaagcagggaggaugaacuauuacuggaccuugcuaaaacccggagacacaauaauguuugaggcaaauggaaaucuaauagcgccaugguaugcuuucgcacuaaguagaggcuuugggucaggcaucaucaccucaaacgcaucgaugcaugagugugacacgaagugucaaacaccccagggagcuauaaacagcagucucccuuuccagaauauccacccagucacaauaggagagugcccaaaauacgucaggaguaccaaauugaggaugguuacaggacuacggaacaucccauccauucaauccagaggucuauuuggagccauugccgguuucauugaagggggauggacuggaaugauagauggaugguaugguuaucaucaucagaaugaacagggaucaggcuaugcugcggaucaaaaaagcacacaaaaugccauuaacgggauuacaaacaaggugaacucuguuaucgagaagaugaacacucaauucacugcuguggguaaagaauucaacaacuuagaaaaaaggauggaaaacuuaaacaaaaaaguugaugauggauuucuggacauuuggacauauaaugcagaauuguugauucuacuggaaaaugaaaggacucuggauuuccaugacucaaaugugaagaaucuguaugaaaaaguuaaaagccaauuaaggaauaaugccaaagaaauaggaaacggguguuuugaguucuaccacaaguguaacaaugaaugcauggaaaguguaaaaaauggaacuuaugauuauccaaaauauucagaagaaucaaaguugaacagggaaaaaauagauggagugaaauuggaaucaaugggggucuaucagauucuggcgaucuacucaacugucgccaguucacuggugcuucuagucucccugggggcaaucagcuucuggauguguucuaaugggucuuugcagugcagaauaugcaucuga

SEQ ID NO: 32150 - RNA, 1701 nt, Artificial Sequence
  hemagglutinin__InfluenzaA__ABP49338
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagcuccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcaaaaagacccaaaguaagaggucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagccuuccuuuccagaauguacacccagucacaauaggagagugcccaaaauacgucaggaguacaaaauuaaggaugguuacaggacuaagaaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32151 - RNA, 1701 nt, Artificial Sequence
  hemagglutinin__InfluenzaA__ABP49349
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacgggaaacuaugcaaacuaaaaggaauagcgccacuacaauuggggaaaugcagcauugccggauggaucuuaggaaacccagaaugugaaucacuguuuucuaagaaaucaugguccuacauugcagaaacaccaaacuccgagaauggaacauguuacccaggguauuucgccgacuaugaagaacugagggaacaauugaguucaguaucaucauucgagagauucgaaauauuccccaaggaaaguucauggcccaaccacaacguaaccaaaggaguaacggcaucaugcucccauaaggggaaaagcagcuuuuacagaaauuugcuauggcugacggagaaaaauggcucguacccaaaucugagcaaauccuaugugaacaacaaagagaaagaaguccuuguacuaugggguauucaucacccgucuaacauagaggaccaaaagaccaucuaucguaaagaaaaugcuuaugucucuguagugucuucacauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguaggggcuuugggucaggaaucaucaccucaaacgcaucgauggaugaaugugacgcgaagugucaaacaccccugggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagcuauugccgguuucauugaagggggauggacuggaaugauugauggaugguaugguuaucaucaucagaaugaacagggaucuggcuaugcugcggaucaaaaaagcacacaaagugccauuaacgggauuacaaacaaggugaacucuauaaucgagaaaaugaacacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaauuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32152 - RNA, 1701 nt, Artificial Sequence
  hemagglutinin__InfluenzaA__ABP49360
augaaagcaaaacuacuaauccuguuaugugcauuuacagcuacagaugcagacacaauauguauaggcuaccaugcgaacaacucaaccgacacuguugacacaguacuugaaaagaacgugacagugacacacucugucaaccuacuugaggacagucacaacggaaaacuaugucgacuaaaaggaauagccccacuacaauuggguaauugcagcauugccggauggauuuuaggaaacccagaaugcgaaucacuguuuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcaucaugcucccauaaugggaaaagcaguuuuuacagaaauuugcuauggcugacgaagaagaauggcucguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauaacaggagauucaccccagaaauagcaaaaagacccaaaguaagagaucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaagaaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaacaaugccaaagaaauaggaaacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 32153 - RNA, 1701 nt, Artificial Sequence
  hemagglutinin__InfluenzaA__ABP49371
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacggaaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 32154 - RNA, 1701 nt, Artificial Sequence; identical to SEQ ID NO: 31891
  hemagglutinin__InfluenzaA__ABP49382

SEQ ID NO: 32155 - RNA, 1698 nt, Artificial Sequence
  hemagglutinin__InfluenzaA__ABP49393
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguauucaucacccgccuaacauaggggaccaaagggcccucuaucauacagaaaaugcuuaugucucuguagugucuucacauuacagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32156 - RNA, 1701 nt, Artificial Sequence
  hemagglutinin__InfluenzaA__ABP49404
augaagacuaucauugcuuugagcuacacucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauaggugcucuauugggagacccucagugugauggcuuccaaaauaagaaaugggaccuuuuuguugaacgcagcaaagccuacagcaauuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacguacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcaccuauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucggaaggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuagaugcaacauuugcauuuga

SEQ ID NO: 32157 - RNA, 1701 nt, Artificial Sequence; identical to SEQ ID NO: 31154
  hemagglutinin__InfluenzaA__ABP49415

SEQ ID NO: 32158 - RNA, 1701 nt, Artificial Sequence
  hemagglutinin__InfluenzaA__ABP49426
augaagacuaucauugcuuugagcuacauuuuaugucugguuuucgcucaaaaacuuccaggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacgaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 32159 - RNA, 1689 nt, Artificial Sequence
  hemagglutinin__InfluenzaA__ABP49437
auggccaucauuuaucucauucuccuguucacagcagugagaggggaccagauaugcauuggauaccaugccaauaauuccacagagaaggucgacacaauucuagagcggaacgucacuguaacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagaaauagcaacaaggccuaaagugaauggacuaggagguagaauggaauucucuuggacccucuuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32160 - RNA, 1701 nt, Artificial Sequence
  hemagglutinin__InfluenzaA__ABP49448
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauaucagaaagacccaaaguaagaggucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagucuuccuuuccagaauguacacccagucacaauaggagagugcccaaaauacgucaggaguacaaaauuaaggaugguuacaggacuaaggaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32161 - RNA, 1689 nt, Artificial Sequence
  hemagglutinin__InfluenzaA__ABP49459
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaccaacauugaacaaaaggucaaccccagacauagcaacaaggccuaaagugaauggacaaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaauacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32162 - RNA, 1689 nt, Artificial Sequence
  hemagglutinin__InfluenzaA__ABP49470
auggccaucauuuaucucauucuccuguucacagcagugagaggagaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaagcacaucaacauugaacaaaaggucaaccccagacauagcaacaaggccuaaagugaauggacuaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32163 - RNA, 1701 nt, Artificial Sequence
  hemagglutinin__InfluenzaA__ABP49492
augaagacuaucauugcuuugagcuacauuuucugucugguuuuugcccaaggccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcaguucuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 32164 - RNA, 1701 nt, Artificial Sequence
  hemagglutinin__InfluenzaA__ABP49503
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauaaacugcacacugauagaugcucuauugggggacccucauugugauguuuuucaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaauggaaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32165 - RNA, 1701 nt, Artificial Sequence
  hemagglutinin__InfluenzaA__ABP49514
augaagaccaucauugcuuugagcuacauuuucuaucuggcucucggccaagaccuuccaggaaaugacaacagcacagcaacgcugugccugggacaucaugcggugccaaacggaacacuagugaaaacaaucacaaaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggugcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggauucaucaugugggccugccagagaggcaacauuaggugcaacauuugcauuuga

SEQ ID NO: 32166 - RNA, 1701 nt, Artificial Sequence
  hemagglutinin__InfluenzaA__ABQ01311
augaaagcaagacuacugauccuguuaugugcacuuucagcuacagaugcagacacaauauguauaggcuaccaugcgaacaauucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuugggaaacccagaaugcgaaucauugcucucuaauagaucaugguccuacauugcagaaacaccaaacucugagaauggaacauguuacccaggagauuucgccgacuaugaggaacugagggagcaauugagcucaguaucaucauucgagagauucgaaauauuccccaaggaaagaucauggcccaaacacaacauaaccagaggaguaacggcagcaugcucccacgcgaagaaaagcaguuuuuacaaaaauuugcucuggcugacggaggcaaauggcucauacccaaaucugagcaaguccuaugugaacaacaaagagaaagaaguccuugugcuaugggguguucaucacccgucuaaaauagaggaucaaaggacccucuaucggaaagaaaaugcuuaugucucuguggugucuucaaauuauaacaggagauucaccccggaaauagcagaaagacccaaaguaagaggucaagcagggagaaugaacuauuacuggacuuugcuagaacccggagacaaaauaauauuugaggcaaauggaaaccuaauagcgccaugguaugcuuucgcacugaguagaggccuuggaucaggaaucaucaccucaaacgcaucaauggaugaaugugacacgaagugucaaacaccccagggagcuauaaacaguagucucccuuuucagaacauacacccagucacaauaggagagugcccaaaauaugucaggaguaccaaauugaggaugguuacaggacuaaggaacaucccauccauucaauccagaggucuguuuggagccauugccgguuucauugaagggggauggacuggaaugguagauggaugguaugguuaccaucaucaaaaugaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuggaaaaaagaauggaaaacuuaaauaaaaaaguugaugauggauuucuggacauuuggacauauaaugcagaauuguugguucuacuggaaaaugaaaggacuuuggauuuccaugacucaaaugugaagaaucuguaugagaaaguaaaaaaccaauugagaaauaaugcaaaggaaauaggaaacggguguuuugaguucuaccacaagugugacaaugaaugcauggaaaguguaaaaaauggaacuuaugauuacccaaaguauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguuccaaugggucuuugcaaugcagaauaugcaucuga

SEQ ID NO: 32167 - RNA, 1701 nt, Artificial Sequence
  hemagglutinin__InfluenzaA__ABQ01322
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagcuccacuacauuuggggaaaugcagcauugccggauggauauuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacguaaccagaggaguaacggcagcaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcaaaaagacccaaaguaagaggucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacgcgaagugucaaacaccccagggagcuauaaacaguagccuuccuuuccagaauguacacccagucacaauaggagagugcccaaaauacgucaggaguacaaaauuaaggaugguuacaggacuaagaaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaguuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32168 - RNA, 1701 nt, Artificial Sequence
  hemagglutinin__InfluenzaA__ABQ01333
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauuccgagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 32169 - RNA, 1701 nt, Artificial Sequence
  hemagglutinin__InfluenzaA__ABQ01344
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacaaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgggaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 32170 - RNA, 1689 nt, Artificial Sequence
  hemagglutinin__InfluenzaA__ABQ01355
auggccaucauuuaucucauucuccuguucacagcagugagaggggaccaaauaugcauuggauaccaugccaauaauuccacagagaaggucgacacaauucuagagcggaacgucacugugacucaugccaaggacauucuugagaagacccauaacgggaaguuaugcaaacuaaacggaaucccuccacuugaacuaggggacuguagcauugccggauggcuccuuggaaauccagaaugugauaggcuucuaagagugccagaaugguccuauauaauggagaaagaaaacccgagagacgguuuguguuauccaggcaguuucaaugauuaugaagaauugaaacaucuccucagcagcgugaaacauuucgagaaagugaggauuuugcccaaagauagauggacacagcauacaacaacuggagguucacgggccugcgcggugucugguaauccaucauucuucaggaacaugaucuggcugacaaagaaaggaucaaauuauccgguugccaaaggaucguacaacaacacaagcggagaacaaaugcuaauaauuuggggggugcaccaucccauugaugaaacagaacaaagaacauuguaccagaauguggaaaccuauguuuccguagucacaucaacauugaacaaaaggucaaccccgaaaauagcaacaaggccuaaagugaauggacuaggagguagaauggaauucucuuggacccuauuggauaugugggacaccauaaauuuugagaguacugguaaucuaauugcuccagaguauggauucaaaauaucgaaaagaggcaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaagggcauuugauggaaucacuaacaagguaaauucugugauugagaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugagugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucccugcagugcaggaucugcauauga

SEQ ID NO: 32171 - RNA, 1701 nt, Artificial Sequence
  hemagglutinin__InfluenzaA__ABQ01366
augaagacuaucauugcuuugagcuacauuuucugucugguuuucgcccaagaccuuccaggaaaugacaacagcacagcaacgcugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugacaaacaaugacaauucugacaaacuauacauuugggggguccaccacccgagcacggacaaagaacaaaccgaccuauauguucaagcaucagggaaagucacagucuccaccaagagaagccagcaaacuauaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagagaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucauaaugugggccugccagaaaggcaacauuaggugcaacauuugcauuuga

SEQ ID NO: 32172 - RNA, 1701 nt, Artificial Sequence; identical to SEQ ID NO: 31937
  hemagglutinin__InfluenzaA__ABQ44383

SEQ ID NO: 32173 - RNA, 1701 nt, Artificial Sequence; identical to SEQ ID NO: 31161
  hemagglutinin__InfluenzaA__ABQ44405

SEQ ID NO: 32174 - RNA, 1701 nt, Artificial Sequence
  hemagglutinin__InfluenzaA__ABQ44416
augaaagcaaaacuacuaguccuguuaugugcauuuacagcuacagaugcagacacaauauguauaggcuaccaugcgaacaacucaaccgacacuguugacacaguacuugaaaagaacgugacagugacacacucugucaaccuacuugaggacagucacaacggaaaacuaugucgacuaaaaggaauagccccacuacaauuggguaauugcaguauugccggauggauuuuaggaaacccagaaugcgaaucacuguuuucuaagaaaucaugguccuacauugcagaaacaccaaacuccgagaauggaacauguuacccaggguauuucgcugacuaugaggaacugagggagcaauugaguucaguaucaucauucgagagauucgaaauauuccccaaagaaagcucauggcccaaccacaccguaaccaaaggaguaacggcaucaugcucccauaaggggaaaagcaguuuuuacagaaauuugcuauggcugacggagaagaauggcucguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauaacaggagauucaccccagaaauagcaaaaagacccaaaguaagagaucaagaaggaagaauuaacuacuacuggacucugcuggaacccgaggacacaauaauauuugaggcaaauggaaaucuaauagcgccaugguaugcuuuugcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaagaaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggguuucuggacauuuggacauauaaugcagaauuguugguucuacuggaaaaugaaaggacuuuggauuuucaugacucaaaugugaagaaucuguaugagaaaguaaaaagccaauuaaagaacaaugccaaagaaauaggaaacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 32175 - RNA, 1701 nt, Artificial Sequence; identical to SEQ ID NO: 30763
  hemagglutinin__InfluenzaA__ABQ44427

SEQ ID NO: 32176 - RNA, 1689 nt, Artificial Sequence
  hemagglutinin__InfluenzaA__ABQ44438
auggccaucauuuauuucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggauuguagcauuaccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccucagcagcguaaaacacuucgagaaaguaaggauucugcccaaagauggauggacacaacauacaacaucuggagguucaaaggccugcgcagugucagguaaaucaucauucuucaggaacauggucuggcugacaaagaaaggaccaaauuauccgguugccaaaagaucguacaacaauacgagcggagagcaaaugcuaauaauuuggggagugcaccauccuaaugaugaggcagaacaaagugcauuguaccagaaagugggaaccuauguuuccgcaagcacaucaacauugaacaaaaggucaaccccagaaauagcagcaaggccugaagugaauggacuaggaaguagaauggaauucucuuggacccuauuggaugugugggacaccauaaauuuugagagcacugguaaucuaguugcaccagaguauggauucaaaauaucgaaaagagguaguucaggaaucaugaagacagaaggaacacuuggaaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccucagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacacucaauuugaagcuguugggaaagaauucaguaacuuagagaaaagacuggaaaacuugaacaaaaagauggaagacggguuucuagauguguggacauacaaugcugagcuucuaguucugauggaaaaugagaggacacuugacuuucaugauucuaaugucaagaaccuguauaauaaagucagaaugcagcugagagacaacgucaaagaacuaggaaauggauguuuugaauuuuaucacaaaugugacgaugaaugcaugaguagugugaaaaacgggacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugauagcugggaucucuuuauggaugugcuccaacgggucucugcagugcagaaucugcauauga

SEQ ID NO: 32177 - RNA, 1689 nt, Artificial Sequence
  hemagglutinin__InfluenzaA__ABQ44460
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacaugaucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggaaguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugggaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcggacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32178 - RNA, 1701 nt, Artificial Sequence
  hemagglutinin__InfluenzaA__ABQ44471
augaaagcaagacuacugauccuguuaugugcacuuucagcuacagaugcagacacaauauguauaggcuaccaugcgaacaauucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuugggaaacccagaaugcgaaucauugcucucuaauagaucaugguccuacauugcagaaacaccaaacucugagaauggaacauguuacccaggagauuucgccgacuaugaggaacugagggagcaauugagcucaguaucaucauucgagagauucgaaauauuccccaaggaaagaucauggcccaaacacaacauaaccagaggaguaacggcagcaugcucccacgcgaagaaaagcaguuuuuacaaaaauuugcucuggcugacggaggcaaauggcucauacccaaaucugagcaaguccuaugugaacaacaaagagaaagaaguccuugugcuaugggguguucaucacccgucuaacauagaggaucaaaggacccucuaucggaaagaaaaugcuuaugucucuguggugucuucaaauuauaacaggagauucaccccggaaauagcagaaagacccaaaguaagaggucaagcagggagaaugaacuauuacuggacucugcuagaacccggagacaaaauaauauuugaggcaaauggaaaccuaauagcgccaugguaugcuuucgcacugaguagaggccuuggaucaggaaucaucaccucaaacgcaucaauggaugaaugugacacgaagugucaaacaccccagggagcuauaaacaauagucucccuuuucagaacauacacccagucacaauaggagagugcccaaaauaugucaggaguaccaaauugaggaugguuacaggacuaaggaacaucccauccauucaauccagaggucuguuuggagccauugccgguuucauugaagggggauggacuggaaugguagauggaugguaugguuaccaucaucaaaaugaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuggaaaaaagaauggaaaacuuaaauaaaaaaguugaugauggauuucuggacauuuggacauauaaugcagaauuguugguucuacuggaaaaugaaaggacuuuggauuuccaugacucaaaugugaagaaucuguaugagaaaguaaaaaaccaauugagaaauaaugcaaaggaaauaggaaacggguguuuugaguucuaccacaagugugacaaugaaugcauggaaaguguaaaaaauggaacuuaugauuacccaaaguauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguuccaaugggucuuugcaaugcagaauaugcaucuga

SEQ ID NO: 32179 - RNA, 1701 nt, Artificial Sequence
  hemagglutinin__InfluenzaA__ABR15797
augaagaccaucauugcuuugagcuacauuuucugucuggcucucggccaagaccuuccaggaaaugacaacagcacagcaacgcugugccugggacaucaugcggugccaaacggaacacuagugaaaacaaucacaaaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggagucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggugcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggaacuucuugucgcucuggagaaucaacauacaauugaccugacugacucggaaaugaacaagcuguuugaaaaaacaaggagacaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32180 - RNA, 1701 nt, Artificial Sequence
  hemagglutinin__InfluenzaA__ABR15808
augaaagcaagacuacugauccuguuaugugcacuuucagcuacagaugcagacacaauauguauaggcuaccaugcgaacaauucaaccgacacuguugacacaguacucgaaaagaaugugacagugacacacucuguaaaccuacucgaagacagccacaacgggaaauuaugcagauuaaaaggaauagccccacuacaauuggggaaauguaacauugccggauggaucuugggaaacccagaaugcgaaucauugcucucuaauagaucaugguccuacauugcagaaacaccaaacucugagaauggaacauguuacccaggagauuucgccgacuaugaggaacugagggagcaauugagcucaguaucaucauucgagagauucgaaauauuccccaaggaaagaucauggcccaaacacaacauaaccagaggaguaacggcagcaugcucccacgcgaagaaaagcaguuuuuacaaaaauuugcucuggcugacggaggcaaauggcucauacccaaaucugagcaaguccuaugugaacaacaaagagaaagaaguccuugugcuaugggguguucaucacccgucuaacauagaggaucaaaggacccucuaucggaaagaaaaugcuuaugucucuguggugucuucaaauuauaacaggagauucaccccggaaauagcagaaagacccaaaguaagaggucaagcagggagaaugaacuauuacuggacuuugcuagaacccggagacaaaauaauauuugaggcaaauggaaaccuaauagcgccaugguaugcuuucgcacugaguagaggccuuggaucaggaaucaucaccucaaacgcaucaauggaugaaugugacacgaagugucaaacaccccagggagcuauaaacaguagucucccuuuucagaacauacacccagucacaauaggagagugcccaaaauaugucaggaguaccaaauugaggaugguuacaggacuaaggaacaucccauccauucaauccagaggucuguuuggagccauugccgguuucauugaagggggauggacuggaaugguagauggaugguaugguuaccaucaucaaaaugaacagggaucuggcuaugcugcggaucaaaaaagcacacaaaaugccauuaacgggauuacaaauaaggugaacucuguuaucgagaaaaugaacacucaauucacagcuguggguaaagaauucaacaaauuggaaaaaagaauggaaaacuuaaauaaaaaaguugaugauggauuuuuggacauuuggacauauaaugcagaauuguugguucuacuggaaaaugaaaggacuuuggauuuccaugacucaaaugugaagaaucuguaugagaaaguaaaaaaccaauugagaaauaaugcaaaggaaauaggaaacggguguuuugaguucuaccacaagugugacaaugaaugcauggaaaguguaaaaaauggaacuuaugauuacccaaaguauucagaggaaucaaaguuaaacagggaaaaaauugauggagugaaauuggaaucaaugggggucuaucagauucuggcgaucuacucaacugucgccaguucacuggugcuucuggucucccugggggcaaucagcuucuggauguguuccaaugggucuuugcaaugcagaauaugcaucuga

SEQ ID NO: 32181 - RNA, 1698 nt, Artificial Sequence; identical to SEQ ID NO: 31246
  hemagglutinin__InfluenzaA__ABR15885

SEQ ID NO: 32182 - RNA, 1698 nt, Artificial Sequence
  hemagglutinin__InfluenzaA__ABR15896
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaagcaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaagugcaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32183 - RNA, 1698 nt, Artificial Sequence; identical to SEQ ID NO: 31245
  hemagglutinin__InfluenzaA__ABR15907

SEQ ID NO: 32184 - RNA, 1698 nt, Artificial Sequence
  hemagglutinin__InfluenzaA__ABR15918
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgcugacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32185 - RNA, 1701 nt, Artificial Sequence
  hemagglutinin__InfluenzaA__ABR15929
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaagggguaucuccagcagaauaagcaucuauuggacaauaguaaaaccgggagacauacuuuuaauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaauguaacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32186 - RNA, 1701 nt, Artificial Sequence
  hemagglutinin__InfluenzaA__ABR15940
augaagacuaucauugcuuugagcuacauuuuaugccugguuuucgcucaaaaacuucccggaaaugacaacagcacggcaacgcugugucuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucggggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauuuccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggguccuauggauuuccuuugccauaucauguuuuuugcuuuguauuguuuugcugggguucaucaugugggccugccaaaaaggcaacauuaggugcaacauuugcauuuga

SEQ ID NO: 32187 - RNA, 1701 nt, Artificial Sequence; identical to SEQ ID NO: 31066
  hemagglutinin__InfluenzaA__ABR15951

SEQ ID NO: 32188 - RNA, 1701 nt, Artificial Sequence
  hemagglutinin__InfluenzaA__ABR15962
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcagagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgaaaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32189 - RNA, 1701 nt, Artificial Sequence
  hemagglutinin__InfluenzaA__ABR22241
augaagacuaucauugcuuugagcuacauuuuaugucuggcuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaaaaguuucuuuaguagauugaauugguugcaccaauuagaauacagauauccagcacugaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauaaguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaaaauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 32190 - RNA, 1701 nt, Artificial Sequence; identical to SEQ ID NO: 31154
  hemagglutinin__InfluenzaA__ABR28515

SEQ ID NO: 32191 - RNA, 1701 nt, Artificial Sequence
  hemagglutinin__InfluenzaA__ABR28592
augaagacuaucauugcuuugagcuacguuuucugucugguuuucgcccaagaccuuccaggaaaugacaacagcacagcaacucugugccugggacaucaugcggugccaaacggaacgcuagugaaaacaaucacgaaugaucagauugaagugacuaaugcuacugaacugguucagaguuccucaacggguaaaauaugcgacaauccucaucgaauccuugauggaauaaacugcacacugauagaugcucuauugggggacccucauugugauggcuuucaaaaugagaaaugggaccuuuucguugaacgcagcaaagcuuucagcaacuguuacccuuaugaugugccagauuaugccucccuuaggucacuaguugccucgucaggcacucuggaguuuaucaaugaaggcuucaauuggacuggggucacucagaaugggggaagcagugcuugcaaaaggggaccugauaacgguuuuuucaguagacugaacugguuguacaaaucaggaagcacauauccagugcagaacgugaccaugccaaacaaugacaacucugacaaacuauacauuugggggguucaccacccgagcacggacaaagaacaaaccgaccuauauguucaagcaucagggaaagucacagucuccaccaagagaagccagcaaacuguaaucccgaaugucgggucuagacccuggguaaggggucugucuaguagaguaagcaucuauuggacaauaguuaaaccgggagacauacugguaauuaauaguaauggaaaccuaauugcuccucgggguuacuucaaaaugcgcacugggaaaagcucaauaaugaggucagaugcaccuauuggcaccugcagcucugaaugcaucacuccaaauggaagcauucccaaugacaagcccuuucaaaacguaaacaagaucacauauggggcaugucccaaguauguuaagcaaaacacucugaaguuggcaacagggaugcggaauguaccagagaaacaaacuagaggcauauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaacugaauaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaccaacauacaauugaucugacugacucggaaaugaacaaacuguuugaaaaaacaaggaggcaacugagggaaaaugcugaggacaugggcaaugguugcuucaaaauauaccacaaaugugacaaugcuugcauagggucaaucagaaaugggacuuaugaccaugauguauacagagacgaagcauuaaacaaccgguuucagaucaaagguguugaacugaagucaggauacaaagacuggauccuguggauuuccuuugccauaucaugcuuuuugcuuuguguuguuuugcugggguucaucaugugggccugccagaaaggcaacauuaggugcaacauuugcauuuga

SEQ ID NO: 32192 - RNA, 1698 nt, Artificial Sequence; identical to SEQ ID NO: 31246
  hemagglutinin__InfluenzaA__ABR28768

SEQ ID NO: 32193 - RNA, 1698 nt, Artificial Sequence
  hemagglutinin__InfluenzaA__ABR28779
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaauuuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32194 - RNA, 1701 nt, Artificial Sequence; identical to SEQ ID NO: 31937
  hemagglutinin__InfluenzaA__ABR28790

SEQ ID NO: 32195 - RNA, 1698 nt, Artificial Sequence
  hemagglutinin__InfluenzaA__ABR28801
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuauccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32196 - RNA, 1701 nt, Artificial Sequence
  hemagglutinin__InfluenzaA__ABR28812
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacaggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggauucaucaugugggccugccaaaaaggcaacauuaggugcaacauuugcauuuga

SEQ ID NO: 32197 - RNA, 1701 nt, Artificial Sequence
  hemagglutinin__InfluenzaA__ABR28823
augaagacuaucauugcuuugagcuacauuuuaugucugguuuucgcucaaaaacuccccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaucacccggguacagacagugaccaaaucagccuauaugcucaagcaucagggagagucacagucucuaccaaaagaagccaacaaacuguaaucccgaauaucggaucuagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32198 - RNA, 1698 nt, Artificial Sequence; identical to SEQ ID NO: 31374
  hemagglutinin__InfluenzaA__ABR28834

SEQ ID NO: 32199 - RNA, 1698 nt, Artificial Sequence; identical to SEQ ID NO: 31346
  hemagglutinin__InfluenzaA__ABR28845

SEQ ID NO: 32200 - RNA, 1701 nt, Artificial Sequence
  hemagglutinin__InfluenzaA__ABR28856
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugauuaugccaaacaaugaaaaauuugacaaauuguacauuugggggguccaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaaaacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguugauugagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 32201 - RNA, 1701 nt, Artificial Sequence
  hemagglutinin__InfluenzaA__ABR28867
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagauagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggcaugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 32202 - RNA, 1701 nt, Artificial Sequence; identical to SEQ ID NO: 31066
  hemagglutinin__InfluenzaA__ABR28878

SEQ ID NO: 32203 - RNA, 1698 nt, Artificial Sequence
  hemagglutinin__InfluenzaA__ABR28900
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucacuccagaaauagccaaaagacccaaggugagagaucaggaaggaagaaucaacuacuacuggacucugcuggaacccggggauacuauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagagaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32204 - RNA, 1701 nt, Artificial Sequence
  hemagglutinin__InfluenzaA__ABR28922
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaguaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32205 - RNA, 1701 nt, Artificial Sequence
  hemagglutinin__InfluenzaA__ABR88080
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32206 - RNA, 1701 nt, Artificial Sequence
  hemagglutinin__InfluenzaA__ABS00315
augaaagcaaaacuacuaguccuguuaugugcauuuacagcuacagaugcagacacaauauguauaggcuaccaugcgaacaacucaaccgacacuguugacacaguacuugaaaagaacgugacagugacacacucugucaaccuacuugaggacagucacaacggaaaacuaugucgacuaaaaggaauagccccacuacaauuggguaauugcagcguugccggauggaucuuaggaaacccagaaugcgaaucacuguuuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaucggcaucaugcucccauaaggggagaagcaguuuuuacagaaauuugcuauggcugacggagaagaauggcucguacccaaaucugagcaaguccuaugugaacaacaaagagagagaaguccuuguacuaugggguguucaucacccgucuaacauaggggagcaaagggccaucuaucauacagaaaaugcuuaugucuccguagugucuucacauuauaacaggagauucaccccagaaauagcaaaaagacccaaaguaagaggucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaagugugaaaaauggaacuuaugacuacccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32207 - RNA, 1701 nt, Artificial Sequence
  hemagglutinin__InfluenzaA__ABS00326
augaaagcaaaacuacuaguccuguuaugugcauuuacagcuacagaugcagacacaauauguauaggcuaccaugcgaacaacucaaccgacacuguugacacaguacuugaaaagaacgugacagugacacacucugucaaccuacuugaggacagucacaacggaaaacuaugucgacuaaaaggaauagccccacuacaauuggguaauugcagcguugccggauggaucuuaggaaacccagaaugcgaaucacuguuuucuaagaaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaucggcaucaugcucccauaaggggagaagcaguuuuuacagaaauuugcuauggcugacggagaagaauggcucguacccaaaucugagcaaguccuaugugaacaacaaagagaaagaaguccuuguacuaugggguguucaucacccgucuaacauaggggagcaaagggccaucuaucauacagaaaaugcuuaugucucaguagugucuucacauuauaacaggagauucaccccagaaauagcaaaaagacccaaaguaagaggucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagagugcccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 32208 - RNA, 1701 nt, Artificial Sequence
  hemagglutinin__InfluenzaA__ABS49899
augaagaccaucauugcuuugagcuacauuuucugucuggcucucggccaagaccuuccaggaaaugacaacaguacagcaacgcugugccugggacaucaugcggugccaaacggaacacuagugaaaacaaucacaaaugaucagauugaagugacuaaugcuacugagcuaguucagaguuccucaacggggaaaauaugcaacaauccucaucgaauccuugauggaauaaacugcacacugauagacgcucuauugggggacccucauugugauguuuuccaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcgucagggagagucacagucucuaccaggagaagccagcaaacuauaaucccgaauaucggguccagacccuggguaaggggucugucuaguagaauaagcaucuauuggacaauaguuaaaccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaauuggcaacagggaugcggaauguaccagagaaacaaacuagaggccuauucggagcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucugaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32209 - RNA, 1701 nt, Artificial Sequence
  hemagglutinin__InfluenzaA__ABS49910
augaagaccaucauugcuuugagcuacauuuucugucuggcucucggccaagaccuuccaggaaaugacaacaguacagcaacgcugugccugggacaucaugcggugccaaacggaacacuagugaaaacaaucacaaaugaucagauugaagugacuaaugcuacugagcuaguucagagcuccucaacggggaaaauaugcaacaauccucaucgaauccuugauggaauaaacugcacacugauagacgcucuauugggggacccucauugugauguuuuccaagaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaaaccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaauuggcaacagggaugcggaauguaccagagaaacaaacuagaggccuauucggcgcaauagcaggcuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgaaaaauuccaucaaaucgaaaaggaauucucugaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaaaugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32210 - RNA, 1701 nt, Artificial Sequence; identical to SEQ ID NO: 31154
  hemagglutinin__InfluenzaA__ABS49965

SEQ ID NO: 32211 - RNA, 1698 nt, Artificial Sequence
  hemagglutinin__InfluenzaA__ABS49976
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauagggaaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcguucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccauaacuccaaugugaagaaucuguaugagaaaguaaaaagccaauuaaagaauaaugccaaagaaauaggaaacggguguuuugaauucuaccacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32212 - RNA, 1698 nt, Artificial Sequence
  hemagglutinin__InfluenzaA__ABS49987
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgcugacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaauaugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32213 - RNA, 1701 nt, Artificial Sequence
  hemagglutinin__InfluenzaA__ABS49998
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacaggagucgcucagaauggaacaagcucugcuugcaaaaggagaucuaauaaaaguuucuuuaguagauugaauugguugcaccaauuaaaauacaaauacccagcacugaacgugauuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggauucaucaugugggccugccaaaaaggcaacauuaggugcaacauuugcauuuga

SEQ ID NO: 32214 - RNA, 1701 nt, Artificial Sequence
  hemagglutinin__InfluenzaA__ABS50009
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcaaaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggauucaucaugugggccugccaaaaaggcaacauuaggugcaacauuugcauuuga

SEQ ID NO: 32215 - RNA, 1701 nt, Artificial Sequence
  hemagglutinin__InfluenzaA__ABS50020
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugaguugguucagaguuccucaacagguagaauaugcgacaguccucaccaaauccuugauggagaaaacugcacacuaauagaugcucuauugggagacccgcauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucgggucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcggaauguaccagagaaacaaacuagaggcauauucggcgcaaucgcggguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggagaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32216 - RNA, 1701 nt, Artificial Sequence
  hemagglutinin__InfluenzaA__ABS50031
augaagacuaucauugcuuugagcuacauguuaugucugguuuucgcucaaaaacuucccggaaaugacaacagcacggcaaugcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggagccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugagagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 32217 - RNA, 1701 nt, Artificial Sequence; identical to SEQ ID NO: 31947
  hemagglutinin__InfluenzaA__ABS50042

SEQ ID NO: 32218 - RNA, 1701 nt, Artificial Sequence
  hemagglutinin__InfluenzaA__ABS50053
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32219 - RNA, 1701 nt, Artificial Sequence
  hemagglutinin__InfluenzaA__ABS50064
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaccacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgaaaaaacgaacgagaaauuccaucaaauugaaaaagaauucucagaaguagaagggagaauucaggaccucgagaaauauguugaggacacuaaaauagaucucuggucguacaaugcggagcuucuuguuucccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32220 - RNA, 1701 nt, Artificial Sequence
  hemagglutinin__InfluenzaA__ABS50075
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucauaagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugcaugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32221 - RNA, 1698 nt, Artificial Sequence
  hemagglutinin__InfluenzaA__ABS71665
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaauccagaaugcgaaucacugauuuccagggaaucaugguccuacauuguagaaaaaccaaguccugagaaugggacauguuacccagggcauuucgccgacuaugaggaacuaagggagcaauugaguucaguaucuucauuugagagauucgaaauauuccccaaagaaagcucauggcccaaccacaccgcaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgcccaacauaggugaccaaagggcccucuaucauacagaaaaugcuuaugucucuguagugucuucacauuauagcagaaaauucaccccagaaauagccaaaagacccaaaguaagagaucaagaaggaagaaucagcuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagagucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32222 - RNA, 1698 nt, Artificial Sequence
  hemagglutinin__InfluenzaA__ABS71666
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaauccagaaugcgaaucacugauuuccagggaaucaugguccuacauuguagaaaaaccaaguccugagaaugggacauguuacccagggcauuucgccgacuaugaggaacuaagggagcaauugaguucaguaucuucauuugagagauucgaaauauuccccaaagaaagcucauggcccaaccacaccgcaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgcccaacauaggugaccaaagggcccucuaucauacagaaaaugcuuaugucucuguagugucuucacauuauagcagaaaauucaccccagaaauagccaaaagacccaaaguaagagaucaagaaggaagaaucagcuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagagucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32223 - RNA, 1698 nt, Artificial Sequence
  hemagglutinin__InfluenzaA__ABS71667
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaaucacugauuuccagggaaucaugguccuacauuguagaaaaaccaaguccugagaaugggacauguuacccagggcauuucgccgacuaugaggaacuaagggagcaauugaguucaguaucuucauuugagagauucgaaauauuccccaaagaaagcucauggcccaaccacaccgcaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguucuuguacuaugggguguucaucacccgcccaacauaggugaccaaagggcccucuaucauacagaaaaugcuuauaucucuguagugucuucacauuauagcagaaaauucaccccagaaauagccaaaagacccaaaguaagagaucaagaaggaagaaucagcuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaagggucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagagucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32224 - RNA, 1698 nt, Artificial Sequence
  hemagglutinin__InfluenzaA__ABS71668
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaaucacugauuuccagggaaucaugguccuacauuguagaaaaaccaaguccugagaauggaacauguuacccagggcauuucgccgacuaugaggaacugagggagcaauugaguucaguaucuucauuugagagauucgaaauauuccccaaagaaagcucauggcccaaccacaccgcauccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucaguuucuggauguguuccaaugggucuuugcaguguagaauaugcaucuaa

SEQ ID NO: 32225 - RNA, 1698 nt, Artificial Sequence
  hemagglutinin__InfluenzaA__ABS71669
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggaguaucagcaucaugcucccauaauggggaaagcaguuuuuacaaaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguuaguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaauuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32226 - RNA, 1698 nt, Artificial Sequence
  hemagglutinin__InfluenzaA__ABS71671
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggaaucaugguccuacauuguagaaaaaccaaauccugagaauggaacauguuacccagggcauuucgcugacuaugaggaacugagggagcaauugaguucaguaucuucauuugagagguucgaaauguuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcaggaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaauuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32227 - RNA, 1698 nt, Artificial Sequence
  hemagglutinin__InfluenzaA__ABS71672
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggaaucaugguccuacauuguagaaaaaccaaauccugagaauggaacauguuacccagggcauuucgcugacuaugaggaacugagggagcgauugaguucaguaucuucauuugagagguucgaaauguuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugcccaaagggcccucuaucauacagaaaaugcuuaugucucuguagugucuucacauuauagcaggaaauucaccccagaaauagccaaaagacccaaaguaagagaucaagaaggaagaaucaacuacuacuggacucugcuugaacccggggauacaauaauauuugaggcaaauggaaaucuaauagcaccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaaggaggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuuaaauaaaaaaguugaugauggguuuauagacauuuggacauauaaugcagaacuguugguccuacuggaaaaugaaaggacuuuggauuuccaugacuccaaugugaagaaucuguaugagaaaguaaaaagccaguuaaagaauaaugccaaagaaauaggaaauggauguuuugaauucuaucacaaguguaacgaugaaugcauggagaguguaaagaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32228 - RNA, 1698 nt, Artificial Sequence
  hemagglutinin__InfluenzaA__ABS71673
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggagaagcaguuuuuacagaaauuuguuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaauacuuaugucucuguagugucuucacauuauagcagaagauucaccccagaaauagccaaaagacccaaggugagagaucaggaaggaagaaucaacuacuacuggacucugcuggaacccggggauacaauaauauucgaggcaaauggaaaucuaauagcaccaagguuugcuuucgcacugaguagaggcuuuggaucaggaaucaucaccucuaaugcaccaauggaugaaugugaugcgaagugucaaacaccucaaggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaccuguaugagaaagugaaaagccaauuaaagaauaaugccaaagaaauaggaaacgggugcuuugaauucuaucacaaguguaacgaugaaugcauggagagugugaaaaauggaacuuaugacuauccaaaauauuccgaagaaucaaaguuaaacagggagaaaauugauggugugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32229 - RNA, 1701 nt, Artificial Sequence
  hemagglutinin__InfluenzaA__ABS71674
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaaugggacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcgggguucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucaaauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugauaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32230 - RNA, 1701 nt, Artificial Sequence
  hemagglutinin__InfluenzaA__ABS71675
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaagaaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccuguauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32231 - RNA, 1701 nt, Artificial Sequence
  hemagglutinin__InfluenzaA__ABS71676
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucauaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32232 - RNA, 1701 nt, Artificial Sequence
  hemagglutinin__InfluenzaA__ABS71677
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacggaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauugacaaaugcaauucugaaugcaucacuccaaauggaagcauucccaaugacaaaccauuucaaaaugugaacagaaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaagagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32233 - RNA, 1701 nt, Artificial Sequence
  hemagglutinin__InfluenzaA__ABS71679
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32234 - RNA, 1701 nt, Artificial Sequence
  hemagglutinin__InfluenzaA__ABS71680
augaagacuaucauugcucugagcuacauccuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaaacugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32235 - RNA, 1701 nt, Artificial Sequence
  hemagglutinin__InfluenzaA__ABS71682
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggauaacauacggggccugucccagauauguuaagcaaaacacucugaaauuggcaacagggaugcgaaacguaccagagaaacaaacuagaggcauauuuggugcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaaugcggagcuucuuguugcccuggagaaccaacauacaauugauuuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32236 - RNA, 1701 nt, Artificial Sequence
  hemagglutinin__InfluenzaA__ABU80177
augaagacuaucauugcuuugagcuacauuuuaugucugguuuucgcucaaaaacuucccguaaaugacaacagcacggcaacgcugugccuggggcaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugcuucauccggcacacuggaguuuaacaaugaaagcuucaauuggacuggagucgcucagaauggaacaagcucuucuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32237 - RNA, 1698 nt, Artificial Sequence
  hemagglutinin__InfluenzaA__ABU80298
augaaaguaaaacuacugguccuguuauguacauuuacagcuacauaugcagacacaauauguauaggguaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccacgguaugcuuucgcacugaguagaggcuuuggaucaggaaucaucaccucaaaugcaccaauggaugaaugugaugcgaagugucaaacaccucagggagcuauaaacagcagucuuccuuuccagaacguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugggugguaugguuaucaucaucagaaugagcaaggaucuggcuaugccgcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguauaagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32238 - RNA, 1701 nt, Artificial Sequence
  hemagglutinin__InfluenzaA__ABU80320
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguggaauaugcgacaguccucaccaaauccuugauggagaaaacugcacacuaauagaugcucuauugggagacccucauugugauagcuuccaaaauaaggaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuaauaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcauaauaagcaucuauuggacaauaguaaaaccgggagacauacuuuugauuaacugcacagggaaucuaauugcuccucgggguuacuucaaaauacgaagugggaaaagcucaauaaugaggucagaugcauccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaacgggaaacugaauagguuaaucgagaaaacgaacgagaaauuccaucaaauugaaaaagaauucucagaaguggaagggagaauucaggaccucgagaaauauguugaggacacuaaaauagaucucuggucguacaacgcggagcuucuuguugcccuggagaaccagcauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaaugggacuuaugaccaugauguauacagagacgaagcauuaaacaaccgguuccagaucaaagguguugagcugaagucaggauacaaagauuggauccuauggauuuccuuugccauaucauguuuuuugcuuuguguugucuugcugggguucaucaugugggccugccaaaaaggcaacauuaggugcaacauuugcauuuga

SEQ ID NO: 32239 - RNA, 1701 nt, Artificial Sequence
  hemagglutinin__InfluenzaA__ABU80331
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcagagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaauuccgaauaucggaucuagacccuggguaaggggugucuccagcagaauaagcaucuauuggacaauaguaaaaccgggagacauacuuuugauuaacagcacagggaaucuaauugcuccuagggguuacuucaaaauacgaagugggaaaagcucaauaaugaggucagaugcacccauuggcaagugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaauuagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32240 - RNA, 1701 nt, Artificial Sequence
  hemagglutinin__InfluenzaA__ABU80400
augaaggcaauacuauuagucuugcuauauacauuuacagccgcaaaugcagacacauuauguauagguuaccaugcaaauaauucaacugacacuguugauacaguacuagaaaagaauguaacaguaacacacucuguuaaccuucuagaagacagacauaacggaaaacuauguaaacuaagggggguagccccauugcauuuggguaaauguaacauugcuggauggcuccugggaaacccagaaugugaauuacuauucacagcaagcucauggucuuacauuguggaaacaucuaacucagacaaugggacauguuacccaggagauuucaucaauuacgaagagcuaagagagcaauugagcucagugucaucauuugaaagauuugagauauuccccaaggcaaguucauggcccaaucaugaaacgaacagaggugugacggcagcaugcccuuaugcuggagcaaacagcuucuacagaaauuuaauauggcugguaaaaaaaggaaauucauacccaaagcucagcaaauccuauguuaacaauaaggagaaggaaguccucgugcuauggggcauucaccauccaccuaccaguacugaccaacaaagucucuaccagaaugcagaugcuuauguuuuuguggggucaucaaaguacaacaagaaauucaagccagaaauagcaacaagacccaaggugagaggucaagcagggagaaugaacuauuacuggacacuaguagagccuggagacacaauaacauucgaagcaacuggaaaucuagugguaccaagauaugccuucgcaaugaaaagagguucuggaucugguauuaucauuucagauacaccaguccacgauuguaauacgacuugucaaacacccaaaggugcuauaaacaccagccucccauuucagaauauacauccagucacaauuggagaauguccaaaguaugucaaaagcacaaaauugagaauggcuacaggacuaaggaauaucccgucuauucaaucuagaggucuguuuggagccauugcuggcuuuauugaggggggauggacaggaaugauagauggaugguacgguuaucaccaucaaaaugagcagggaucaggauaugcagcugaccgaaagagcacacagaaugccauugacgggaucacuaacaaaguaaacucuguuauugaaaagaugaacacacaauucacagcaguggguaaagaauucaaccaccuggaaaaaagaauagagaauuuaaacagaaagguugaugaugguuuucuggauauuuggacuuacaaugccgaacuguugguucuauuggaaaaugaaagaacuuuagauuaccaugacucaaaugugaagaaccuauaugagaaagugagaagccagcuaaaaaacaaugccaaggaaauuggaaauggcugcuuugaauuuuaccacaaaugugaugacacgugcauggagagcgucaaaaaugggacuuaugauuacccaaaauacucagaagaaucaaaacuaaacagagaggaaauagaugggguaaagcuggaaucaacaaggauuuaccagaucuuggcgaucuauucaacugucgccaguucauugguacuguuagucucccugggggcaaucaguuucuggaugugcuccaaugggucuuuacagugcagaauauguauuuaa

SEQ ID NO: 32241 - RNA, 1701 nt, Artificial Sequence
  hemagglutinin__InfluenzaA__ABU92572
augaagacuaucauugcuuugagcuacauuuuaugucugguuuucacucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuauuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32242 - RNA, 1701 nt, Artificial Sequence
  hemagglutinin__InfluenzaA__ABU92573
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucaagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 32243 - RNA, 1701 nt, Artificial Sequence
  hemagglutinin__InfluenzaA__ABU92575
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuaaacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32244 - RNA, 1701 nt, Artificial Sequence
  hemagglutinin__InfluenzaA__ABU92576
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagguugaauugguugcaccaauuaaaauacaaauauccagcacugaacgugacuaugccgaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccuguccuagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32245 - RNA, 1701 nt, Artificial Sequence
  hemagglutinin__InfluenzaA__ABU92577
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggauacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32246 - RNA, 1701 nt, Artificial Sequence; identical to SEQ ID NO: 30576
  hemagglutinin__InfluenzaA__ABU92578

SEQ ID NO: 32247 - RNA, 1701 nt, Artificial Sequence
  hemagglutinin__InfluenzaA__ABU92579
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggaaggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuucagaucaaagguguugagcugaagucaggauacaaagauuggauccuguggauuuccuuugccauaucauguuuuuugcuuuguguuguuuugcugggguucaucaugugggccugccagaaaggcaacauuaggugcaacauuugcauuuga

SEQ ID NO: 32248 - RNA, 1701 nt, Artificial Sequence; identical to SEQ ID NO: 30576
  hemagglutinin__InfluenzaA__ABU92580

SEQ ID NO: 32249 - RNA, 1701 nt, Artificial Sequence; identical to SEQ ID NO: 32241
  hemagglutinin__InfluenzaA__ABU92581

SEQ ID NO: 32250 - RNA, 1701 nt, Artificial Sequence
  hemagglutinin__InfluenzaA__ABU92582
augaagacuaucauugcuuugagcuacauuuuaugccugguuuucgcucaaaaacuucccggaaaugacaacagcacggcaacgcugugccuggggcaucaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacagaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaaugugccagagaaacaaacuagaggcauauucggugcaaucgcaggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauauaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32251 - RNA, 1701 nt, Artificial Sequence; identical to SEQ ID NO: 32250
  hemagglutinin__InfluenzaA__ABU92583

SEQ ID NO: 32252 - RNA, 1701 nt, Artificial Sequence
  hemagglutinin__InfluenzaA__ABU92584
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaagauacaaauauccagcacugaacgugacuaugccaaacaaugaaaaauuugacaaauuguacauuugggggguccaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaaaacucugaaauuggcaacagggaugcggaaugugccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguugauugagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaggcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 32253 - RNA, 1701 nt, Artificial Sequence
  hemagglutinin__InfluenzaA__ABU92586
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucaaauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugccuuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaagaauuggauccuauggauuuccuuugccauaucauguuuuuugcuuuguguugcuuuguugggguucaucaugugggccugccaaaaaggcaacauuaggugcaacauuugcauuuga

SEQ ID NO: 32254 - RNA, 1701 nt, Artificial Sequence
  hemagglutinin__InfluenzaA__ABU92587
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacugcaaucccgaauaucggguccagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32255 - RNA, 1701 nt, Artificial Sequence
  hemagglutinin__InfluenzaA__ABU92588
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggaaaucuaauaacaguuucuuuaguagauugaauugguugacccacuuaaaauucaaauacccagcauugaaugugaccaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaauuccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggaguuucuuguugcccuggagaaccaacauacaauugaucuaaccgacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32256 - RNA, 1701 nt, Artificial Sequence
  hemagglutinin__InfluenzaA__ABU92590
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaagauauaccacaaaugugacaaugccugcauagggucaaucagaaauggaacuuaugaccaugauguauacagagaugaagcacuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32257 - RNA, 1701 nt, Artificial Sequence
  hemagglutinin__InfluenzaA__ABU92591
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguggaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32258 - RNA, 1701 nt, Artificial Sequence
  hemagglutinin__InfluenzaA__ABU92592
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32259 - RNA, 1701 nt, Artificial Sequence
  hemagglutinin__InfluenzaA__ABU92593
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccggccaaaaaggcaacaaaaggugcaacauuugcauuuga

SEQ ID NO: 32260 - RNA, 1701 nt, Artificial Sequence
  hemagglutinin__InfluenzaA__ABU92594
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacaggugaaauaugcaacaguccucaucagauccuugauggagaaagcugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccuguauaggaucaaucagaaauggaacuuaugaucaugauguauacagagaugaagcauuaaacaaccgguuccagaucaaaggcguugagcugaagucaggauacaaagauuggauccuauggauuuccuuugccauaucauguuuuuugcuuuguguugcuuugucgggguucaucaugugggccugccaaaaaggcaacauuaggugcaacauuugcauuuga

SEQ ID NO: 32261 - RNA, 1701 nt, Artificial Sequence
  hemagglutinin__InfluenzaA__ABU92595
augaagacuaucauugcuuugagcuacauucuaugucugguuuucgcucaaaaacuucccgaaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32262 - RNA, 1701 nt, Artificial Sequence
  hemagglutinin__InfluenzaA__ABU92596
augaagacuaucauugcuuugagcuacauucuaugucugguuuuugcucaaaaacuucccggaaaugacaacagcacggcaacgcugugccuugggcaccaugcaguaccaaacggaacgauggugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagcccacagcaacuguuacccuuaugaugugccggauuaugccucccuuaggucacuaauugccucauccggcacccuggaguuuaacaaugaaagcuucaauuggacuggagucacucaaaaugggacaagcucugcuugcaaaaggagaucugauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaauguaauucuggaugcaucacuccaaauggaagcauucccaaugacaaaccauuucaaaauguaaacaggaucacauauggggccugccccagauauguuaagcaaaacacucuaaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32263 - RNA, 1701 nt, Artificial Sequence
  hemagglutinin__InfluenzaA__ABU92597
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggaaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggaucuuauggauuuccuuugccauaucauguuuuuugcuuuguguugcuuuguugggguucaucaugugggccugccaaaaaggcaacauuaggugcaacauuugcauuuga

SEQ ID NO: 32264 - RNA, 1701 nt, Artificial Sequence
  hemagglutinin__InfluenzaA__ABU92601
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacaucugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 32265 - RNA, 1701 nt, Artificial Sequence
  hemagglutinin__InfluenzaA__ABU92602
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 32266 - RNA, 1701 nt, Artificial Sequence
  hemagglutinin__InfluenzaA__ABU92603
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32267 - RNA, 1701 nt, Artificial Sequence
  hemagglutinin__InfluenzaA__ABU92604
augaagacuaucauugcuuugagcuacauucuaugucugguuuucgcucagaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccagaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32268 - RNA, 1701 nt, Artificial Sequence; identical to SEQ ID NO: 32266
  hemagglutinin__InfluenzaA__ABU92605

SEQ ID NO: 32269 - RNA, 1701 nt, Artificial Sequence
  hemagglutinin__InfluenzaA__ABU92606
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaauugggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32270 - RNA, 1701 nt, Artificial Sequence
  hemagglutinin__InfluenzaA__ABU92608
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagguugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaucaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32271 - RNA, 1701 nt, Artificial Sequence; identical to SEQ ID NO: 32270
  hemagglutinin__InfluenzaA__ABU92609

SEQ ID NO: 32272 - RNA, 1701 nt, Artificial Sequence
  hemagglutinin__InfluenzaA__ABU92610
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugagguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacucaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucgcauauggggccugucccagauauguuaagcaaaacacucugaaauuggcaacagggaugagaaauguaccagagaaacaaacuagaggcauauuuggcgcaaucgcagguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugagcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauauga

SEQ ID NO: 32273 - RNA, 1701 nt, Artificial Sequence
  hemagglutinin__InfluenzaA__ABU92611
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaucaggaaaaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauccaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucauaugggccugccuaaaaggcaacauuaggugcaacauuugcauuuga

SEQ ID NO: 32274 - RNA, 1701 nt, Artificial Sequence
  hemagglutinin__InfluenzaA__ABU92612
augaagacuaucauugcuuugagcuacauucuaugucugguuuucgcucaaaaacuucccggaaaugacaacagcacggcaacgcugugccuugggcaccaugcaguaccaaacggaacgauggugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaauaacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcagcugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32275 - RNA, 1701 nt, Artificial Sequence
  hemagglutinin__InfluenzaA__ABU92613
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaguagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauugaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32276 - RNA, 1701 nt, Artificial Sequence; identical to SEQ ID NO: 32261
  hemagglutinin__InfluenzaA__ABU92614

SEQ ID NO: 32277 - RNA, 1701 nt, Artificial Sequence
  hemagglutinin__InfluenzaA__ABU92615
augaagacuaucauugcuuugagcuacauucuaugucugguuuucgcccaaaaacuucccggaaaugacaacagcacggcaacgcugugccuugggcaccaugcaguaccaaacggaacgauagugagaacaaucacgaaugaccaaauugaaguuacuaaugcuacugagcugguucagaguuccucaacagguggcauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacugguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaaugucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaauguaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagauugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccauaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32278 - RNA, 1701 nt, Artificial Sequence
  hemagglutinin__InfluenzaA__ABU92617
augaagacuaucauugcuuugagcuacauucuaugucugguuuucgcucaaaaacuucccggaaaugacaacagcacggcaacgcugugccuugggcaccauucaguaccaaacggaacgauagugaaaacaaucacgaaugaucaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguugcuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32279 - RNA, 1701 nt, Artificial Sequence; identical to SEQ ID NO: 32275
  hemagglutinin__InfluenzaA__ABU92619

SEQ ID NO: 32280 - RNA, 1701 nt, Artificial Sequence; identical to SEQ ID NO: 32261
  hemagglutinin__InfluenzaA__ABU92620

SEQ ID NO: 32281 - RNA, 1701 nt, Artificial Sequence
  hemagglutinin__InfluenzaA__ABU92622
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucaaauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagaucuguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 32282 - RNA, 1701 nt, Artificial Sequence
  hemagglutinin__InfluenzaA__ABU92623
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuuacuuuguguugcuuuguugggguucaucaugugggccugccagaaaggcaacauuaggugcaacauuugcauuuga

SEQ ID NO: 32283 - RNA, 1701 nt, Artificial Sequence
  hemagglutinin__InfluenzaA__ABU92624
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcauuaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32284 - RNA, 1701 nt, Artificial Sequence
  hemagglutinin__InfluenzaA__ABU92625
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32285 - RNA, 1701 nt, Artificial Sequence
  hemagglutinin__InfluenzaA__ABU92626
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 32286 - RNA, 1701 nt, Artificial Sequence
  hemagglutinin__InfluenzaA__ABU92627
augaagacuaucauugcuuugagcuacauucuauguaugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaaccgcccagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32287 - RNA, 1701 nt, Artificial Sequence; identical to SEQ ID NO: 32266
  hemagglutinin__InfluenzaA__ABU92628

SEQ ID NO: 32288 - RNA, 1701 nt, Artificial Sequence; identical to SEQ ID NO: 32284
  hemagglutinin__InfluenzaA__ABU92631

SEQ ID NO: 32289 - RNA, 1701 nt, Artificial Sequence
  hemagglutinin__InfluenzaA__ABU92632
augaagacuaucaucgcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucaucuggcacacuggaguuuaacaaugaaagcuucaauuggacuggaguaacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggauccagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucuaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccuagagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagagaaaaugcugaggauaugggcaaugguuguuucaaaauauaccacaaaugugacaaugccugcauagggucaaucagaaauggaacuuaugaccaugauguauacagagaugaagcauuaaauaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32290 - RNA, 1701 nt, Artificial Sequence
  hemagglutinin__InfluenzaA__ABU92635
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucaauaguugccucauccggcacacuggaguuuaacaaugaaagcuucaacuggacuggagucacucagaauggaacaagcucugcuugcaaaaggaaaucuaauaaaaguuucuuuaguagauugaauugguugacccacuuaaaauacaaauacccagcauugaacgugacuaugccaaacaaugaaaaauuugacaaauuguacauuugggggguucaccacccggguacggacaaugaccaaaucagccuguaugcucaagcaucaggaagaaucacagucucuaccaaaagaagccaacaaacuguaaucccgaauaucggaucuagacccaggguaagggacgucuccagcagaauaagcaucuauuggacaauaguaaaaccgggagacauacuuuugauuaacagcacagguaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucagacaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaggggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32291 - RNA, 1701 nt, Artificial Sequence
  hemagglutinin__InfluenzaA__ABU92636
augaagacuaucauugcuuugagcuacauucuaugucugguuuucgcucaaaaacuucccggaaaugacaacagcacggcaacgcugugccuugggcaucaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32292 - RNA, 1701 nt, Artificial Sequence
  hemagglutinin__InfluenzaA__ABU92637
augaagacuaucauugcuuugagcuacauucuaugucugguuuucgcucaaaaacuucccggaaaugacaacagcacggcaacgcugugccuugggcaccaugcaguaccaaacggaacgacagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaucaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32293 - RNA, 1701 nt, Artificial Sequence
  hemagglutinin__InfluenzaA__ABU92639
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauacgaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggggacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucagacaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauauugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32294 - RNA, 1701 nt, Artificial Sequence
  hemagglutinin__InfluenzaA__ABU92640
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauaugucaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugauucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuugugcugcuuuguugggguucaucaugugggccugccaaaaaggcaacauuaggugcaacauuugcauuuga

SEQ ID NO: 32295 - RNA, 1701 nt, Artificial Sequence
  hemagglutinin__InfluenzaA__ABU92641
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggaaaucuaauaacaguuucuuuaguagauugaauugguugacccacuuaaaauucaaauacccagcauugaacgugaccaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaauuccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcagagcuucuuguugcccuggagaaccaacauacaauugaucuaaccgacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32296 - RNA, 1701 nt, Artificial Sequence
  hemagglutinin__InfluenzaA__ABU92642
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucauagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaagcaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32297 - RNA, 1701 nt, Artificial Sequence
  hemagglutinin__InfluenzaA__ABU92643
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaagaagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccauaauguguacagagaugaagcauuaaacaaccgguuccagaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32298 - RNA, 1701 nt, Artificial Sequence
  hemagglutinin__InfluenzaA__ABU92645
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugagguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucgcauauggggccugucccagauauguuaagcaaaacacucugaaauuggcaacagggaugagaaauguaccagagaaacaaacuagaggcauauuuggcgcaaucgcagguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcauugagcugaagucaggauacaaagauuggauccuauggauuuccuuugccauaucauguuuuuugcuuuguguuguuuuguugggguucaucaugugggccugccaaaaaggcaacauuaggugcaacauuugcauauga

SEQ ID NO: 32299 - RNA, 1701 nt, Artificial Sequence
  hemagglutinin__InfluenzaA__ABU92646
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32300 - RNA, 1701 nt, Artificial Sequence; identical to SEQ ID NO: 32265
  hemagglutinin__InfluenzaA__ABU92647

SEQ ID NO: 32301 - RNA, 1701 nt, Artificial Sequence
  hemagglutinin__InfluenzaA__ABU92648
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32302 - RNA, 1701 nt, Artificial Sequence
  hemagglutinin__InfluenzaA__ABU92649
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaagccauuucaaaacguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaaugagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugucagaaaggcaacauuaggugcaacauuugcauuuga

SEQ ID NO: 32303 - RNA, 1701 nt, Artificial Sequence
  hemagglutinin__InfluenzaA__ABU92650
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaccaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32304 - RNA, 1701 nt, Artificial Sequence
  hemagglutinin__InfluenzaA__ABU92651
augaagacuaucauugcuuugagcuacauucuaugucugguuuucgcucaaaaacuucccggaaaugacaacagcacggcaacgcugugccuugggcaccaugcaguaccaaacggaacgauagugaaaaccaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuuacaaugaaagcuucgauuggacuggagucacucagaauggaacaagcucugcuugcaaaaggagaucugauaaaaguuucuuuaguagauugaauugguugacccacuuaaaauacaaauacccagcauuaaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcucaagucaggauacaaagauuggauccuauggauuuccuuugccauaucauguuuuuugcuuuguguugcuuugcugggguucaucaugugggccugccaaaaaggcaacauuaggugcaacauuugcauuuga

SEQ ID NO: 32305 - RNA, 1701 nt, Artificial Sequence
  hemagglutinin__InfluenzaA__ABU92652
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguacagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacagacagugaccaaaucagccuauaugcucaagcaucaggaagaaucacagucucuaccaaaagaagccaacaaacuguaaucccgaauaucggaucuagacccaggguaagggaugucucuagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauuccgaaugcaucacuccaaauggaagcauucccaaugacaaaccauuucaaaauguaaacaggaucacauauggggccugucccagauauguuaagcaaaacacuuugaaauuggcaacagggaugcgaaauguaccagagaaacaaacuagaggcauauuuggcgcaaucgcgggcuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauauaggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32306 - RNA, 1701 nt, Artificial Sequence; identical to SEQ ID NO: 32266
  hemagglutinin__InfluenzaA__ABU92653

SEQ ID NO: 32307 - RNA, 1701 nt, Artificial Sequence
  hemagglutinin__InfluenzaA__ABU92654
augaagacuaucauugcuuugagcuacauucuaugucugguuuucgcucaaaaacuucccggaaaugacaacagcacggcaacacugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaaaaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucucaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaaugcugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32308 - RNA, 1701 nt, Artificial Sequence
  hemagglutinin__InfluenzaA__ABU92655
augaagacuaucauugcuuugagcuacauucuaugucugguuuucgcucaaaaacuucccggaaaugacaacagcacggcaacacugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaaugcugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaaaucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32309 - RNA, 1701 nt, Artificial Sequence
  hemagglutinin__InfluenzaA__ABU92656
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32310 - RNA, 1701 nt, Artificial Sequence
  hemagglutinin__InfluenzaA__ABU92657
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggaaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32311 - RNA, 1701 nt, Artificial Sequence
  hemagglutinin__InfluenzaA__ABU92658
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccaaaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32312 - RNA, 1701 nt, Artificial Sequence
  hemagglutinin__InfluenzaA__ABU92659
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuauacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguaugguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32313 - RNA, 1701 nt, Artificial Sequence
  hemagglutinin__InfluenzaA__ABU92660
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaucaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32314 - RNA, 1701 nt, Artificial Sequence
  hemagglutinin__InfluenzaA__ABU92661
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugaguuggagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32315 - RNA, 1701 nt, Artificial Sequence
  hemagglutinin__InfluenzaA__ABU92662
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32316 - RNA, 1701 nt, Artificial Sequence; identical to SEQ ID NO: 32266
  hemagglutinin__InfluenzaA__ABU92663

SEQ ID NO: 32317 - RNA, 1701 nt, Artificial Sequence
  hemagglutinin__InfluenzaA__ABU92664
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaauauuaggugcaacauuugcauuuga

SEQ ID NO: 32318 - RNA, 1701 nt, Artificial Sequence
  hemagglutinin__InfluenzaA__ABU92665
augaagacuaucauugcuuugagcuacauucuaugucugguuuucgcucaaaaacuucccggaaaugacaacagcacggcaacgcugugccuugggcaccaugcaguaccaaacggaacaauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuacgcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcugcagaucucaaaagcacucaagcagcaaucaaccaaaucaaugggaagcugaauagguugaucggaaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32319 - RNA, 1701 nt, Artificial Sequence; identical to SEQ ID NO: 32266
  hemagglutinin__InfluenzaA__ABU92666

SEQ ID NO: 32320 - RNA, 1701 nt, Artificial Sequence; identical to SEQ ID NO: 30850
  hemagglutinin__InfluenzaA__ABU92667

SEQ ID NO: 32321 - RNA, 1701 nt, Artificial Sequence
  hemagglutinin__InfluenzaA__ABU92668
augaagacuaucauugcuuugagcuacauuuuaugucugguuuucgcucaaaaacuucccguaaaugacaacagcacggcaacgcuaugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauacccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucggagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32322 - RNA, 1701 nt, Artificial Sequence
  hemagglutinin__InfluenzaA__ABU92669
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagaguaacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaaaugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32323 - RNA, 1701 nt, Artificial Sequence
  hemagglutinin__InfluenzaA__ABU92670
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccagaauaaggaaugggaccuuuuuguugaacgcagcacagccuacagcaacuguuacccuuaugauguaccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagauuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32324 - RNA, 1701 nt, Artificial Sequence
  hemagglutinin__InfluenzaA__ABU92671
augaagacuaucauugcuuugagccacauuuuaugucugguuuucgcucaaaaacuucccguaaaugauaacagcacggcaacgcuaugccugggacaccaugcagugccaaacggaacgcuagugaaaacaaucacgaaugaccacauugaagugacuaaugcuacugagcugguucagaguuccucaacagguagaauaugcgacauuccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaccagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaagcagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32325 - RNA, 1701 nt, Artificial Sequence
  hemagglutinin__InfluenzaA__ABU92672
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32326 - RNA, 1701 nt, Artificial Sequence; identical to SEQ ID NO: 30576
  hemagglutinin__InfluenzaA__ABU92673

SEQ ID NO: 32327 - RNA, 1701 nt, Artificial Sequence
  hemagglutinin__InfluenzaA__ABU92674
augaagacuaucauugcuuugagcuacauuuuaugucugguuuucgcucaaaaacuucccguaaaugacaacagcacggcaacgcugugccugggacaccaugcagugccaaacggaacgcuagugaaaacaaucacgaaugaccacauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagaacagccuacagcaacuguuacccuuaugaugugccggauuaugccucccuuaggucacuaguugccucauccggcacacuggaguuuaacaaugaaagcuucaauuggacuggagucgcucagaauggaacaagcucugcuugcaaaaggagaucuauuaaaaguuucuuuaguagauugaauugguugcaccaauuaaaauacaaauauccagcacugaacgugacuaugccaaacaaugaaaaauuugacaaauuguacauuugggggguucaccacccgaguacggacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuuuaaaauacgaagugggaaaagcucaauaaugaggucaaaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugguggacgguugguacgguuucaggcaucaaaauucugagggcacaggacaagcagcagaucuuaaaagcacucaagcagcaaucaaccaaaucaacgggaaacugaauagguuaaucgagaaaacaaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 32328 - RNA, 1701 nt, Artificial Sequence
  hemagglutinin__InfluenzaA__ABU92675
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuauacauuugggggguucaccacccggguacagacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauggggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32329 - RNA, 1701 nt, Artificial Sequence; identical to SEQ ID NO: 32310
  hemagglutinin__InfluenzaA__ABU92676

SEQ ID NO: 32330 - RNA, 1701 nt, Artificial Sequence; identical to SEQ ID NO: 32258
  hemagglutinin__InfluenzaA__ABU92677

SEQ ID NO: 32331 - RNA, 1701 nt, Artificial Sequence
  hemagglutinin__InfluenzaA__ABU92678
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuacugggagacccucagugugauggccuccaaaacaagaaaugggaccuuuuuguugaacgcagcaaagccuacagcaacuguuacccuuaugaugugccggauuaugccucccuuaggucacuaauugccucauccggcacacuggaguuuaacaaugagagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagaccccggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaauugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcacuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32332 - RNA, 1701 nt, Artificial Sequence
  hemagglutinin__InfluenzaA__ABU92680
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32333 - RNA, 1701 nt, Artificial Sequence
  hemagglutinin__InfluenzaA__ABU92681
augaagacuaucauugcuuugagcuacauucuaugucugguuuucgcucaaaaacuucccgaaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucagacaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32334 - RNA, 1701 nt, Artificial Sequence
  hemagglutinin__InfluenzaA__ABU92682
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaacguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcucuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugucagaaaggcaacauuaggugcaacauuugcauuuga

SEQ ID NO: 32335 - RNA, 1701 nt, Artificial Sequence; identical to SEQ ID NO: 32266
  hemagglutinin__InfluenzaA__ABU92683

SEQ ID NO: 32336 - RNA, 1701 nt, Artificial Sequence
  hemagglutinin__InfluenzaA__ABU92684
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaccaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucugauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuucagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32337 - RNA, 1701 nt, Artificial Sequence
  hemagglutinin__InfluenzaA__ABU92685
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaaucgaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugaaaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32338 - RNA, 1701 nt, Artificial Sequence; identical to SEQ ID NO: 32284
  hemagglutinin__InfluenzaA__ABU92686

SEQ ID NO: 32339 - RNA, 1701 nt, Artificial Sequence; identical to SEQ ID NO: 32266
  hemagglutinin__InfluenzaA__ABU92687

SEQ ID NO: 32340 - RNA, 1701 nt, Artificial Sequence
  hemagglutinin__InfluenzaA__ABU92688
augaagacuaucauugcuuugagcuacauucuaugucugguuuucgcucaaaaacuccccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcccaagcaucaggaagaaucacagucucuaccaaaagaagccaacaaacuguaaucccgaauaucggaucuagaccuaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaacaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32341 - RNA, 1701 nt, Artificial Sequence; identical to SEQ ID NO: 32266
  hemagglutinin__InfluenzaA__ABU92689

SEQ ID NO: 32342 - RNA, 1701 nt, Artificial Sequence
  hemagglutinin__InfluenzaA__ABU92691
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaguaaugagaucagaugcacccauuggcaaaugcaauucugaaugcaucacuccaaauggaagcauucccaaugacaaaccauuucaaaaugucaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaaugcggagcuucuuguugcccuggagaaccaacauacaauugaucuaacugacucagaaaugaacaaacuguuugaaagaacaaagaagcaacugagggaaaaugcugaggauauaggcaaugguuguuucaaaauauaccacaaaugugacaaugccugcauagggucaaucagaaauggaacuuaugaccauaauguguacagagaugaagcauuaaacaaccgguuccagaucaaagguguugagcugaagucgggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32343 - RNA, 1701 nt, Artificial Sequence
  hemagglutinin__InfluenzaA__ABU92692
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccuuaucagauccuugauggagaaaacugcacacuaauagaugcucuauugggagacccucagugugauggcuuccaaaauaagaaaugggaccuuuuuguugaacgcagcaaagccuacagcaacugcuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacagacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauugaacaaccgguuucagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32344 - RNA, 1701 nt, Artificial Sequence
  hemagglutinin__InfluenzaA__ABU92693
augaaggcuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccaaaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32345 - RNA, 1701 nt, Artificial Sequence
  hemagglutinin__InfluenzaA__ABU92694
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaggaauucucagaaguagaagggagaauucaggaccucgagaaauauguugaggacacuaaaguagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32346 - RNA, 1701 nt, Artificial Sequence
  hemagglutinin__InfluenzaA__ABU92695
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagaccccggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32347 - RNA, 1701 nt, Artificial Sequence
  hemagglutinin__InfluenzaA__ABU92696
augaagacuaucauugcuuugggcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32348 - RNA, 1701 nt, Artificial Sequence
  hemagglutinin__InfluenzaA__ABU92697
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggacauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32349 - RNA, 1701 nt, Artificial Sequence
  hemagglutinin__InfluenzaA__ABU92698
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32350 - RNA, 1701 nt, Artificial Sequence
  hemagglutinin__InfluenzaA__ABU92699
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32351 - RNA, 1701 nt, Artificial Sequence
  hemagglutinin__InfluenzaA__ABU92700
augaagacuaucauugcuuugagcuacauucuaugucugguuuucgcucaaaaacuucccgaaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaagauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32352 - RNA, 1701 nt, Artificial Sequence
  hemagglutinin__InfluenzaA__ABU92701
augaagacuaucauugcuuugagcuacauucuaugucugguuuucgcucaaaaacuucccgaaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauuaaacgugacuaugccaaacaaugaaagauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccggcuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32353 - RNA, 1701 nt, Artificial Sequence; identical to SEQ ID NO: 31116
  hemagglutinin__InfluenzaA__ABU92702

SEQ ID NO: 32354 - RNA, 1701 nt, Artificial Sequence
  hemagglutinin__InfluenzaA__ABU92703
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32355 - RNA, 1701 nt, Artificial Sequence
  hemagglutinin__InfluenzaA__ABU92704
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcaacaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaagauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32356 - RNA, 1701 nt, Artificial Sequence
  hemagglutinin__InfluenzaA__ABU92705
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugaacugguucaaaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguccaccacccggguacggacaaugaccaaaucagccuauaugcucaagcaccaggaagaaucacagucucuaccaaaagaagccaacaaacuguaaucccgaauaucggaucuagaccccgaguaagggauauucccagcagaauaagcaucuauuggacaauaguaaaaccgggagacauacuuuugauuaacagcacagggaaucuaauugcuccucgggguuacuucaaaauacgaagugggaaaagcucgauaaugagaucagaugcacccauuggcaaaugcaaaucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacucgaggcauauuuggcgcaaucgcgggguucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcagagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccggaucaaaaguguugagcugaagucaggauacaaagauuggauccuauggauuucauuugccauaucauguuuuuugcuuuguguugcuuuguugggguucaucaugugggccugccaaaaaggcaacauuaggugcaacauuugcauuuga

SEQ ID NO: 32357 - RNA, 1701 nt, Artificial Sequence
  hemagglutinin__InfluenzaA__ABU92706
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagucgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 32358 - RNA, 1701 nt, Artificial Sequence; identical to SEQ ID NO: 32266
  hemagglutinin__InfluenzaA__ABU92707

SEQ ID NO: 32359 - RNA, 1701 nt, Artificial Sequence
  hemagglutinin__InfluenzaA__ABU92708
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuugucgaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32360 - RNA, 1701 nt, Artificial Sequence
  hemagglutinin__InfluenzaA__ABU92709
augaagacuaucauugcuuuaagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggaaaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32361 - RNA, 1701 nt, Artificial Sequence
  hemagglutinin__InfluenzaA__ABU92710
augaagacuaucauugcuuuaagcuacauuuuaugucugguuuucgcucaaaaacuucccggaaaugacaacagcacggcaacgcugugccuggggcaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaacuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuagacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauaugggcccugucccagauauguuaagcaaaacacucugaaauuggcaacagggaugcggaaugugccagaaaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32362 - RNA, 1701 nt, Artificial Sequence; identical to SEQ ID NO: 32265
  hemagglutinin__InfluenzaA__ABU92711

SEQ ID NO: 32363 - RNA, 1701 nt, Artificial Sequence
  hemagglutinin__InfluenzaA__ABU92712
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcaguaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaagcuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32364 - RNA, 1701 nt, Artificial Sequence; identical to SEQ ID NO: 32266
  hemagglutinin__InfluenzaA__ABU92713

SEQ ID NO: 32365 - RNA, 1701 nt, Artificial Sequence; identical to SEQ ID NO: 32266
  hemagglutinin__InfluenzaA__ABU92714

SEQ ID NO: 32366 - RNA, 1701 nt, Artificial Sequence
  hemagglutinin__InfluenzaA__ABU92715
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuaccgagcugguucagauuuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuugaaauacaaauacccagcauugaacgugacuaugccaaacaaugaaaaauuugaaaaauuguacauuugggggguucaccacccggguacggacagugaccaaaucaaccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacagaaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32367 - RNA, 1701 nt, Artificial Sequence; identical to SEQ ID NO: 32266
  hemagglutinin__InfluenzaA__ABU92716

SEQ ID NO: 32368 - RNA, 1701 nt, Artificial Sequence
  hemagglutinin__InfluenzaA__ABU92717
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccagaguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32369 - RNA, 1701 nt, Artificial Sequence
  hemagglutinin__InfluenzaA__ABU92718
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuagaugcaacauuugcauuuga

SEQ ID NO: 32370 - RNA, 1701 nt, Artificial Sequence
  hemagglutinin__InfluenzaA__ABU92719
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaacguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugucagaaaggcaacauuaggugcaacauuugcauuuga

SEQ ID NO: 32371 - RNA, 1701 nt, Artificial Sequence
  hemagglutinin__InfluenzaA__ABU92720
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuauuccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaccaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32372 - RNA, 1701 nt, Artificial Sequence
  hemagglutinin__InfluenzaA__ABU92721
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccagguacggacagugaccaaaucagccuauaugcucaagcaucaggaagaaucacagucucuaccaaaagaagccaacaaacuguaaccccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaauguaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32373 - RNA, 1701 nt, Artificial Sequence
  hemagglutinin__InfluenzaA__ABU92722
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaagaagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32374 - RNA, 1701 nt, Artificial Sequence
  hemagglutinin__InfluenzaA__ABU92723
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaucacaaaugugacaaugccugcauagggucaaucagaaauggaacuuaugaccaugauguguacagagaugaagcauuaaacaaccgguuccagaucaaagguguugagcugaagucaggauacaaagacuggauccuauggauuuccuuugccauaucauguuuuuugcuuuguguugcuuuguugggguucaucaugugggccugucagaaaggcaacauuaggugcaacauuugcauuuga

SEQ ID NO: 32375 - RNA, 1701 nt, Artificial Sequence; identical to SEQ ID NO: 32360
  hemagglutinin__InfluenzaA__ABU92724

SEQ ID NO: 32376 - RNA, 1701 nt, Artificial Sequence
  hemagglutinin__InfluenzaA__ABU92725
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaauuaaccuauaugcucaagcaucaggaagaaucacaguuucuaccaaaagaagccaacaaacuguaaucccgaauaucggaucuagacccaggguaagggauguccccagcagaauaagcaucuauuggacaauaguaaaaccgggagacuuacuuuugauuaacagcacagggaaucuaauugcuccucgggguuacuucaaaauacgaagugggaaaagcucaauaaugagaucagaugcacccauuggcaaaugcaauucugaaugcaucaccccaaauggaagcauucccaaugacaagccauuucaaaauguaaacaggaucacauauggggcuugucccagauauguuaagcaaaacacccugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgaaaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32377 - RNA, 1701 nt, Artificial Sequence; identical to SEQ ID NO: 32360
  hemagglutinin__InfluenzaA__ABU92726

SEQ ID NO: 32378 - RNA, 1701 nt, Artificial Sequence
  hemagglutinin__InfluenzaA__ABU92727
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacaaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagacuuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaggauuggauccuauggauuuccuuugccauaucauguuuuuugcuuuguguugcuuuguugggguucaucaugugggccugccaaaaaggcaacauuaggugcaacauuugcauuuga

SEQ ID NO: 32379 - RNA, 1701 nt, Artificial Sequence
  hemagglutinin__InfluenzaA__ABU92728
augaagacuaucauugcuuugagcuacauucuaugucagguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32380 - RNA, 1701 nt, Artificial Sequence; identical to SEQ ID NO: 32379
  hemagglutinin__InfluenzaA__ABU92729

SEQ ID NO: 32381 - RNA, 1701 nt, Artificial Sequence; identical to SEQ ID NO: 32258
  hemagglutinin__InfluenzaA__ABU92730

SEQ ID NO: 32382 - RNA, 1701 nt, Artificial Sequence
  hemagglutinin__InfluenzaA__ABU92731
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggggacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacguuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32383 - RNA, 1701 nt, Artificial Sequence
  hemagglutinin__InfluenzaA__ABU92732
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacauacaaugaccaaaucagccuauaugcucaagcaucaggaagaaucacagucucuaccaaaagaagccaacaaacuguaaucccgaauaucgggucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32384 - RNA, 1701 nt, Artificial Sequence
  hemagglutinin__InfluenzaA__ABU92733
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuauugaacgcagcaaagccuacagcaacuguuacccuuaugaugugccggauuaugccucccuuaggucacuaguugccucauccggcacacuggaauuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcuucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaguagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuauaaccaugauguauacagagaugaagcauugaacaaccgguuccagaucaaagguguugagcugaagucaggauacaaagauuggauccuauggauuuccuuugccauaucauguuuuuugcuuuguguugcuuuguugggauucaucaugugggccugccaaaaaggcaacauuaggugcaacauuugcauuuga

SEQ ID NO: 32385 - RNA, 1701 nt, Artificial Sequence
  hemagglutinin__InfluenzaA__ABU92734
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauagcaguuucuuuaguagauugaauugguugacccacuuaaaauucaaauacccagcauugaacgugacuaugccaaacaaugaagaauuugacaaauuguacauuugggggguucaccacccggguacagacaaugaccaaaucagccuauaugcucaagcaucaggaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccaaaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32386 - RNA, 1701 nt, Artificial Sequence
  hemagglutinin__InfluenzaA__ABU92735
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugagguuacuaaugcuacugagcugguucagaguuccucaacagguggaauaugcggcaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccauuuaaaauucaaauacccagcauugaacgugacuaugccaaacaaugaaaaauuugacaaauuguacauuuggggaguucaccacccggguacggacaaugaccaaaucagccuauaugcucaagcaccagcaagaaucacagucucuaccaaaagaagccaacaaacuguaaucccgaauaucggaucuagacccaggguaagggauauccccagcagaauaagcaucuauuggacaauaguaaaaccgggagacauacuuuugauuaacagcacagggaaucuaauugcuccucgggguuacuucaaaauacuaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccaugucauguuuuuugcuuuguguugcuuuguugggguucaucaugugggccugccaaaaaggcaacauuaggugcaacauuugcauuuga

SEQ ID NO: 32387 - RNA, 1701 nt, Artificial Sequence; identical to SEQ ID NO: 32332
  hemagglutinin__InfluenzaA__ABU92737

SEQ ID NO: 32388 - RNA, 1701 nt, Artificial Sequence
  hemagglutinin__InfluenzaA__ABU92738
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaacgaccaaauugaaguuacuaaugcuacugaacugguucaaaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaccaggaagaaucacagucucuaccaaaagaagccaacaaacuguaauuccgaauaucggaucuagaccccgaguaagggauauccccagcagaauaagcaucuauuggacaauaguaaaaccgggagacauacuuuugauuaacagcacagggaaucuaauugcuccucgggguuacuucaaaauacgaagugggaaaagcucgauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacucgaggcauauuuggcgcaaucgcgggguucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaccuaacugacucagaaaugaacaaacuguuugaaagaacaaagaagcaacugagggagaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32389 - RNA, 1701 nt, Artificial Sequence
  hemagglutinin__InfluenzaA__ABU92739
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuuugauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccaucggcaaaugcaauucugaaugcaucacuccaaauggaagcauucccaaugacaaaccauuucagaauguaaacaggaucacauauggggccugucccagguauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugaguugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32390 - RNA, 1701 nt, Artificial Sequence
  hemagglutinin__InfluenzaA__ABU92740
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagauacucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguuuacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32391 - RNA, 1701 nt, Artificial Sequence
  hemagglutinin__InfluenzaA__ABU92741
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaacgaccaaauugaaguuacuaaugcuacugaacugguucaaaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaccaggaagaaucacagucucuaccaaaagaagccaacaaacuguaauuccgaauaucggaucuagaccccgaguaagggauauccccagcagaauaagcaucuauuggacaauaguaaaaccgggagacauacuuuugauuaacagcacagggaaucuaauugcuccucgggguuacuucaaaauacgaagugggaaaagcucgauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacucgaggcauauuuggcgcaaucgcgggguucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggagaaugcugaggauaugggcaaugguuguuucaaaauauaccacaaaugugacaaugccugcauagggucaaucagaaauggaacuuaugaccaugauauauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32392 - RNA, 1701 nt, Artificial Sequence
  hemagglutinin__InfluenzaA__ABU92742
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaagcaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32393 - RNA, 1701 nt, Artificial Sequence
  hemagglutinin__InfluenzaA__ABU92743
augaagacuaucauugcuuugagcuacauucuauaucugguuuucgcucaaaaacuucccgaaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaacagguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32394 - RNA, 1701 nt, Artificial Sequence; identical to SEQ ID NO: 32354
  hemagglutinin__InfluenzaA__ABU92744

SEQ ID NO: 32395 - RNA, 1701 nt, Artificial Sequence
  hemagglutinin__InfluenzaA__ABU92745
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaacgaccaaauugaaguuacuaaugcuacugaacugguucaaaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaccaggaagaaucacagucucuaccaaaagaagccaacaaacuguaauuccgaauaucggaucuagaccccgaguaagggauauccccagcagaauaagcaucuauuggacaauaguaaaaccgggagacauacuuuugauuaacagcacagggaaucuaauugcuccucgggguuacuucaaaauacgaauugggaaaagcucgauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacucgaggcauauuuggcgcaaucgcgggguucauagaaaaugguugggagggaaugguggaugguugguacgguuucaggcaucaaaauucugagggaauagggcaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggagaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32396 - RNA, 1701 nt, Artificial Sequence
  hemagglutinin__InfluenzaA__ABU92746
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaagauaugggcaaugguuguuucaaaauauaccacaaaugugacaaugccugcauaggaucaaucagaaauggaacuuaugaccaugauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32397 - RNA, 1701 nt, Artificial Sequence; identical to SEQ ID NO: 32357
  hemagglutinin__InfluenzaA__ABU92747

SEQ ID NO: 32398 - RNA, 1701 nt, Artificial Sequence
  hemagglutinin__InfluenzaA__ABU92748
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagacugaauugguugacccacucaaaauucaaauacccagcauugaacgugacuaugccaaacaaugaaaaauuugacaaauuguacauuugggggguucaccacccggguacggacaaugaccaaaccuucuuguaugcucaagcaucaggaagaaucacagucucuaccaaaagaagccaacaaacuguaaucccgaauaucggauccagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauugguaaaugcaauucugaaugcaucacuccaaauggaagcauucccaaugacaaaccauuucaaaauguaaacagaaucacauauggggccugucccagauauguuaagcaaaacacucugaaauuggcaacagggaugagaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32399 - RNA, 1701 nt, Artificial Sequence; identical to SEQ ID NO: 32357
  hemagglutinin__InfluenzaA__ABU92749

SEQ ID NO: 32400 - RNA, 1701 nt, Artificial Sequence
  hemagglutinin__InfluenzaA__ABU92750
augaagacuaucauugcuuugagcuacauucuaugucugguuuucgcucaaaaacuucccggaaaugacaaccgcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 32401 - RNA, 1701 nt, Artificial Sequence
  hemagglutinin__InfluenzaA__ABU92751
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggaacacuggaguuuaacaaugaaagcuucaauuggacuggagucacucagaauggaacaagcucugcuugcaaaagaagaucuaauaaaaguuucuuuaguagauugaauugguugacccauuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32402 - RNA, 1701 nt, Artificial Sequence
  hemagglutinin__InfluenzaA__ABU92752
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcccuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugacaaaaguuucuuuaguagauugaauugguugacccacuuaaaauacaaauacccagcauugaacguaaccaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32403 - RNA, 1701 nt, Artificial Sequence
  hemagglutinin__InfluenzaA__ABU92753
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaagcuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32404 - RNA, 1701 nt, Artificial Sequence; identical to SEQ ID NO: 32266
  hemagglutinin__InfluenzaA__ABU92754

SEQ ID NO: 32405 - RNA, 1701 nt, Artificial Sequence
  hemagglutinin__InfluenzaA__ABU92755
augaagacuaucauugcuuugagcuacauucuaugucugguuuucgcucaaaaacuucccggaaaugacaacggcacggcaacacugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucagccuauaugcucaagcaucaggaagaaucacagucucuaccaaaagaagccaacaaacuguaaucccgaauaucggaucuagacccaggguaagggauguccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaaugcugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccauaauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32406 - RNA, 1701 nt, Artificial Sequence
  hemagglutinin__InfluenzaA__ABU92756
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucggggcuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccagaaaggcaacauuaggugcaacauuugcauuuga

SEQ ID NO: 32407 - RNA, 1701 nt, Artificial Sequence
  hemagglutinin__InfluenzaA__ABU92757
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcgacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauugaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagggggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32408 - RNA, 1701 nt, Artificial Sequence; identical to SEQ ID NO: 32266
  hemagglutinin__InfluenzaA__ABU92758

SEQ ID NO: 32409 - RNA, 1701 nt, Artificial Sequence; identical to SEQ ID NO: 32266
  hemagglutinin__InfluenzaA__ABU92759

SEQ ID NO: 32410 - RNA, 1701 nt, Artificial Sequence
  hemagglutinin__InfluenzaA__ABU92760
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacaggugaaauaugcaacaguccccaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucgauuggacuggagucacucagaauggaacaagcucugcuugcaaaaggagaucugauaaaaguuucuuuaguagauugaauugguugacccacuuaaaauacaaauacccagcauuaaacguaacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagccgaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucggaaguagaaggaagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguguacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32411 - RNA, 1698 nt, Artificial Sequence
  hemagglutinin__InfluenzaA__ABV29579
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacgccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaaaaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32412 - RNA, 1698 nt, Artificial Sequence
  hemagglutinin__InfluenzaA__ABV29612
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaguagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagcaauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggggucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32413 - RNA, 1698 nt, Artificial Sequence
  hemagglutinin__InfluenzaA__ABV29634
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaagcaccaaguccugagaauggaacauguuacccaggauauuuugccgacuaugaggagcugagggagcaauugaguucaguaucuucauuugagagguucgaaauauuccccaaagagagcucauggcccaaccacacaguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32414 - RNA, 1698 nt, Artificial Sequence
  hemagglutinin__InfluenzaA__ABV29645
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagaaaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaacguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32415 - RNA, 1698 nt, Artificial Sequence
  hemagglutinin__InfluenzaA__ABV29667
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagauucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaaugaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32416 - RNA, 1698 nt, Artificial Sequence
  hemagglutinin__InfluenzaA__ABV29678
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuucggaucaggaaucaucaccucaaaugcaccaguggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32417 - RNA, 1698 nt, Artificial Sequence
  hemagglutinin__InfluenzaA__ABV29689
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccaccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggauuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32418 - RNA, 1698 nt, Artificial Sequence
  hemagglutinin__InfluenzaA__ABV29700
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32419 - RNA, 1701 nt, Artificial Sequence
  hemagglutinin__InfluenzaA__ABV29711
augaagacuaucauugcuuugagcuacauucuaugucugguuuucgcucaaaaacuucccggaaaugacaacagcacggcaacgcugugccuugggcaucaugcaguaccaaacggaacgauagugaaaacaaucacgaaugaccaaauugaaguuacuaaugcuacugagcuaguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggaacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugcaugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32420 - RNA, 1701 nt, Artificial Sequence
  hemagglutinin__InfluenzaA__ABV29722
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucuuagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32421 - RNA, 1698 nt, Artificial Sequence
  hemagglutinin__InfluenzaA__ABV29733
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcgaagugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaaugcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaagugugacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32422 - RNA, 1698 nt, Artificial Sequence
  hemagglutinin__InfluenzaA__ABV29744
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggggucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32423 - RNA, 1698 nt, Artificial Sequence
  hemagglutinin__InfluenzaA__ABV29755
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaguccugagaauggaacauguuacccaggauauuucgccgacuaugaggagcugagggagcaauugaguucaguaucuucauuugagagguucgaaauauuccccaaagagagcucauggcccaaccacacaguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggguaaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgauuuacucaacagucgccaguucccugguucuuuuggucucccugggggcaaucagcuucuggauguguuccaaugggucuuugcaguguagaauaugcaucuaa

SEQ ID NO: 32424 - RNA, 1698 nt, Artificial Sequence
  hemagglutinin__InfluenzaA__ABV29766
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32425 - RNA, 1698 nt, Artificial Sequence
  hemagglutinin__InfluenzaA__ABV29777
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcgaagugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32426 - RNA, 1698 nt, Artificial Sequence
  hemagglutinin__InfluenzaA__ABV29788
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaacguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32427 - RNA, 1698 nt, Artificial Sequence
  hemagglutinin__InfluenzaA__ABV29799
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucucccuuuccagaauguacacccagucacaauaggagaguguccaaaguaugucaggaguacaaaauuaagaaugguuacaggacuaaggaacaucccauccauucaauccagaggguuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32428 - RNA, 1701 nt, Artificial Sequence
  hemagglutinin__InfluenzaA__ABV29821
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaauagaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaagugcaacauuugcauuuga

SEQ ID NO: 32429 - RNA, 1698 nt, Artificial Sequence
  hemagglutinin__InfluenzaA__ABV29832
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32430 - RNA, 1698 nt, Artificial Sequence
  hemagglutinin__InfluenzaA__ABV29865
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32431 - RNA, 1698 nt, Artificial Sequence
  hemagglutinin__InfluenzaA__ABV29876
augaaaguaaaacuacugauuuuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32432 - RNA, 1701 nt, Artificial Sequence
  hemagglutinin__InfluenzaA__ABV29898
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcagagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32433 - RNA, 1701 nt, Artificial Sequence
  hemagglutinin__InfluenzaA__ABV29909
augaagacuaucauugcuuugagcuacauucuaugucugguuuucgcucaaaaacuuccuggaaaugacaacagcacggcaacgcugugccuugggcaucaugcaguaccaaacggaacgauagugaaaacaaucacgagugaccaaauugaaguuacuaaugcuacugagcugguucagaauuccucaauagguggaaucugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaagaauuugacaaauuguacauuugggggguucaccacccggguacggacaaugaccaaaucagccuauaugcucaagcaccaggaagaaucacagucucuaccaaaagaagccaacaaacuguaaucccgaauaucggaucuagaccccgaguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauugacaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaauggcugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaccuaacugacucagaaaugaacaaauuguuugaaagaacaaaaaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32434 - RNA, 1698 nt, Artificial Sequence
  hemagglutinin__InfluenzaA__ABV29920
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguuugaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32435 - RNA, 1698 nt, Artificial Sequence
  hemagglutinin__InfluenzaA__ABV29942
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcgaagugccaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaaugcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32436 - RNA, 1698 nt, Artificial Sequence
  hemagglutinin__InfluenzaA__ABV29953
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaagguaaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32437 - RNA, 1698 nt, Artificial Sequence
  hemagglutinin__InfluenzaA__ABV29964
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcugaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32438 - RNA, 1698 nt, Artificial Sequence
  hemagglutinin__InfluenzaA__ABV29986
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggauuuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcaccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32439 - RNA, 1698 nt, Artificial Sequence
  hemagglutinin__InfluenzaA__ABV29997
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggggguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32440 - RNA, 1698 nt, Artificial Sequence
  hemagglutinin__InfluenzaA__ABV30008
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaacguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugaaaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32441 - RNA, 1698 nt, Artificial Sequence
  hemagglutinin__InfluenzaA__ABV30019
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguggagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32442 - RNA, 1698 nt, Artificial Sequence
  hemagglutinin__InfluenzaA__ABV30030
augaaaguaaaacuacugguucuguuauguacauuuacagcuacauaugcagacacaauauguauaggcuaccaugccaacaacucgaccgacacuguugacacaguacuugagaaaaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugauuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32443 - RNA, 1698 nt, Artificial Sequence
  hemagglutinin__InfluenzaA__ABV30041
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagccacaauggaaaacuaugucuacuaaaaggaacagccccacuacaauuggguaauugcagcguugccggauggaucuuaggaaacccagaaugcgaauuacugauuucuaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacagggcuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaagugaaaaaccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuugaucucccugggggcaaucagcuucuggauguguuccaaugggucuuuacaguguagaauaugcaucuaa

SEQ ID NO: 32444 - RNA, 1701 nt, Artificial Sequence
  hemagglutinin__InfluenzaA__ABV30063
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuucaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaauaccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32445 - RNA, 1701 nt, Artificial Sequence
  hemagglutinin__InfluenzaA__ABV30074
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32446 - RNA, 1698 nt, Artificial Sequence; identical to SEQ ID NO: 32439
  hemagglutinin__InfluenzaA__ABV30085

SEQ ID NO: 32447 - RNA, 1698 nt, Artificial Sequence; identical to SEQ ID NO: 32439
  hemagglutinin__InfluenzaA__ABV30096

SEQ ID NO: 32448 - RNA, 1698 nt, Artificial Sequence; identical to SEQ ID NO: 32430
  hemagglutinin__InfluenzaA__ABV30107

SEQ ID NO: 32449 - RNA, 1698 nt, Artificial Sequence
  hemagglutinin__InfluenzaA__ABV30129
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacagggcuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32450 - RNA, 1698 nt, Artificial Sequence
  hemagglutinin__InfluenzaA__ABV30140
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuaaaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaucacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32451 - RNA, 1698 nt, Artificial Sequence
  hemagglutinin__InfluenzaA__ABV30151
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauagugggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggggaguguccaaaguaugucaggagugcaaaauuaagaaugguuacaggacuaaggaacaucccauccauucaaucccgagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32452 - RNA, 1698 nt, Artificial Sequence
  hemagglutinin__InfluenzaA__ABV30162
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccagggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuauguaucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32453 - RNA, 1698 nt, Artificial Sequence; identical to SEQ ID NO: 32437
  hemagglutinin__InfluenzaA__ABV30173

SEQ ID NO: 32454 - RNA, 1698 nt, Artificial Sequence
  hemagglutinin__InfluenzaA__ABV30184
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuguggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaaugaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32455 - RNA, 1701 nt, Artificial Sequence
  hemagglutinin__InfluenzaA__ABV30217
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauugguaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32456 - RNA, 1701 nt, Artificial Sequence
  hemagglutinin__InfluenzaA__ABV30228
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaccaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32457 - RNA, 1701 nt, Artificial Sequence
  hemagglutinin__InfluenzaA__ABV30261
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaguugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagguauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaaugggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagcugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32458 - RNA, 1701 nt, Artificial Sequence
  hemagglutinin__InfluenzaA__ABV30272
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguaaauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32459 - RNA, 1698 nt, Artificial Sequence
  hemagglutinin__InfluenzaA__ABV30283
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggaguugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacagggcuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauugacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggaguaaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32460 - RNA, 1698 nt, Artificial Sequence
  hemagglutinin__InfluenzaA__ABV30294
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaucacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggagggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32461 - RNA, 1698 nt, Artificial Sequence
  hemagglutinin__InfluenzaA__ABV30305
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaggaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32462 - RNA, 1698 nt, Artificial Sequence; identical to SEQ ID NO: 32430
  hemagglutinin__InfluenzaA__ABV30316

SEQ ID NO: 32463 - RNA, 1698 nt, Artificial Sequence
  hemagglutinin__InfluenzaA__ABV30327
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaucacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32464 - RNA, 1698 nt, Artificial Sequence
  hemagglutinin__InfluenzaA__ABV30338
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaacuugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32465 - RNA, 1698 nt, Artificial Sequence
  hemagglutinin__InfluenzaA__ABV30349
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32466 - RNA, 1698 nt, Artificial Sequence
  hemagglutinin__InfluenzaA__ABV30360
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggaguugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacagggcuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauugacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggaauaaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32467 - RNA, 1698 nt, Artificial Sequence; identical to SEQ ID NO: 32418
  hemagglutinin__InfluenzaA__ABV30371

SEQ ID NO: 32468 - RNA, 1701 nt, Artificial Sequence
  hemagglutinin__InfluenzaA__ABV30382
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagauugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaucgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32469 - RNA, 1701 nt, Artificial Sequence
  hemagglutinin__InfluenzaA__ABV30393
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccccaucagauccuugauggagaaaacugcacucuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaggaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32470 - RNA, 1701 nt, Artificial Sequence
  hemagglutinin__InfluenzaA__ABV30404
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaaauguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauauccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggaucuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32471 - RNA, 1701 nt, Artificial Sequence
  hemagglutinin__InfluenzaA__ABV30415
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuuggggaguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccaaauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagagcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32472 - RNA, 1701 nt, Artificial Sequence
  hemagglutinin__InfluenzaA__ABV30426
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcauaacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32473 - RNA, 1701 nt, Artificial Sequence
  hemagglutinin__InfluenzaA__ABV30437
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaucacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcauaacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32474 - RNA, 1701 nt, Artificial Sequence; identical to SEQ ID NO: 32472
  hemagglutinin__InfluenzaA__ABV30448

SEQ ID NO: 32475 - RNA, 1698 nt, Artificial Sequence
  hemagglutinin__InfluenzaA__ABV30459
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugugaauuacugauuuccaaggaaucaugguccuacauuguagaggcaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuguggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32476 - RNA, 1701 nt, Artificial Sequence; identical to SEQ ID NO: 32472
  hemagglutinin__InfluenzaA__ABV30470

SEQ ID NO: 32477 - RNA, 1698 nt, Artificial Sequence; identical to SEQ ID NO: 32430
  hemagglutinin__InfluenzaA__ABV30492

SEQ ID NO: 32478 - RNA, 1698 nt, Artificial Sequence
  hemagglutinin__InfluenzaA__ABV30503
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccauaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcaccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacccaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32479 - RNA, 1701 nt, Artificial Sequence; identical to SEQ ID NO: 32445
  hemagglutinin__InfluenzaA__ABV30514

SEQ ID NO: 32480 - RNA, 1698 nt, Artificial Sequence
  hemagglutinin__InfluenzaA__ABV30525
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauagugggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaauacaccaaugggugaaugugaugcgaagugucaaacaccucagggagcuauaaacaguagucuuccuuuccagaauguacauccagucacaauaggggaguguccaaaguaugucaggagugcaaaauuaagaaugguuacaggacuaaggaacaucccauccauucaaucccgagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32481 - RNA, 1698 nt, Artificial Sequence; identical to SEQ ID NO: 32429
  hemagglutinin__InfluenzaA__ABV30536

SEQ ID NO: 32482 - RNA, 1698 nt, Artificial Sequence
  hemagglutinin__InfluenzaA__ABV30547
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuagggaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgccuaacauaggagaccaaagggcccucuaucauacagaaaaugccuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcgaagugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32483 - RNA, 1698 nt, Artificial Sequence
  hemagglutinin__InfluenzaA__ABV30558
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucaaaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32484 - RNA, 1698 nt, Artificial Sequence
  hemagglutinin__InfluenzaA__ABV30569
augaaaguaaaacuacugauucuguuauguacauuuaccgcuacauaugcagacacaauauguauaggcuaccaugccaacaacucgaccgacacuguugacacaguacuugagaagaaugugacagugacacacucugucaaccuacuugaggacaaucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaaucaagagguuuauuuggagccauugcugguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32485 - RNA, 1698 nt, Artificial Sequence; identical to SEQ ID NO: 32429
  hemagglutinin__InfluenzaA__ABV30580

SEQ ID NO: 32486 - RNA, 1698 nt, Artificial Sequence
  hemagglutinin__InfluenzaA__ABV30591
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuucagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32487 - RNA, 1698 nt, Artificial Sequence; identical to SEQ ID NO: 32424
  hemagglutinin__InfluenzaA__ABV30602

SEQ ID NO: 32488 - RNA, 1698 nt, Artificial Sequence
  hemagglutinin__InfluenzaA__ABV30613
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcagcagaucaaaaaagcacacaaaaugccauuaacgggauuacaaacaaggugaauucuguaauugagaaaaugaacacucaauucacagcugugggcaaagaauucaacaaauuggaaagaaggaugaaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32489 - RNA, 1698 nt, Artificial Sequence
  hemagglutinin__InfluenzaA__ABV30624
augaaaguaaaacuacugauucuguuauguacauuuaccgcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaaucaagagguuuauuuggagccauugcugguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32490 - RNA, 1701 nt, Artificial Sequence
  hemagglutinin__InfluenzaA__ABV30646
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacguacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32491 - RNA, 1701 nt, Artificial Sequence
  hemagglutinin__InfluenzaA__ABV30657
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32492 - RNA, 1701 nt, Artificial Sequence; identical to SEQ ID NO: 32491
  hemagglutinin__InfluenzaA__ABV45860

SEQ ID NO: 32493 - RNA, 1698 nt, Artificial Sequence; identical to SEQ ID NO: 32459
  hemagglutinin__InfluenzaA__ABV45871

SEQ ID NO: 32494 - RNA, 1698 nt, Artificial Sequence
  hemagglutinin__InfluenzaA__ABV45882
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagaggcuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32495 - RNA, 1698 nt, Artificial Sequence
  hemagglutinin__InfluenzaA__ABV45893
augaaaguaaaacugcuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcaaagugucaaacaccucagggagcuauaaacagcagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32496 - RNA, 1701 nt, Artificial Sequence
  hemagglutinin__InfluenzaA__ABV45904
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcuuugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagaccuagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32497 - RNA, 1698 nt, Artificial Sequence; identical to SEQ ID NO: 32482
  hemagglutinin__InfluenzaA__ABV45926

SEQ ID NO: 32498 - RNA, 1698 nt, Artificial Sequence
  hemagglutinin__InfluenzaA__ABV45937
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugagacaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32499 - RNA, 1698 nt, Artificial Sequence; identical to SEQ ID NO: 32451
  hemagglutinin__InfluenzaA__ABV45948

SEQ ID NO: 32500 - RNA, 1698 nt, Artificial Sequence
  hemagglutinin__InfluenzaA__ABV45959
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugccuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucaaaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32501 - RNA, 1701 nt, Artificial Sequence
  hemagglutinin__InfluenzaA__ABV45970
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaccagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggaucaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacugugaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacaaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32502 - RNA, 1701 nt, Artificial Sequence
  hemagglutinin__InfluenzaA__ABV45981
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccugaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugagugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguguacagagaugaagcauuaaacaaccgguuccagaucaagggcguugagcugaagucaggauacaaagauuggaucauauggauuuccuuugccauaucauguuuuuugcuuuguguugcuuuguugggguucaucaugugggccugccaaaagggcaacauuaggugcaacauuugcauuuga

SEQ ID NO: 32503 - RNA, 1698 nt, Artificial Sequence
  hemagglutinin__InfluenzaA__ABV82551
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggagaagaaugguuuguauccaaaccugagcaaguccuaugcaaacaacaaagagaaagaaguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggacaaaugugaugcgaagugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32504 - RNA, 1701 nt, Artificial Sequence
  hemagglutinin__InfluenzaA__ABV82562
augaagacuaucauugcuuugagcuacauuuuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaagaagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32505 - RNA, 1701 nt, Artificial Sequence; identical to SEQ ID NO: 32445
  hemagglutinin__InfluenzaA__ABW36168

SEQ ID NO: 32506 - RNA, 1698 nt, Artificial Sequence
  hemagglutinin__InfluenzaA__ABW36179
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccguuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32507 - RNA, 1698 nt, Artificial Sequence; identical to SEQ ID NO: 32461
  hemagglutinin__InfluenzaA__ABW36190

SEQ ID NO: 32508 - RNA, 1698 nt, Artificial Sequence
  hemagglutinin__InfluenzaA__ABW36201
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccggcuucauugaagggggguggacuggaaugguagauggaugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggaaaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32509 - RNA, 1698 nt, Artificial Sequence
  hemagglutinin__InfluenzaA__ABW36212
augaaaguaaaacuacugguucuguuauguacauuuacagcuacauaugcagacacaauauguauaggcuaccaugccaacaauucaaccgacacuguugacacagugcuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagaacucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuugggaucaggaaucaucaccucaaaugcaccaauggaugaaugugaugcgaaaugucaaacaccucagggagcuauaaacagcagucuuccuuuccagaauguacacccagucacaauaggagagugucccaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggaccuauaaugcagaauuguugguucuacuggaaaaugaaaggacuuuggauuuccaugacuccaacgugaagaaucuguaugagaaaguaaaaggccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32510 - RNA, 1698 nt, Artificial Sequence; identical to SEQ ID NO: 32426
  hemagglutinin__InfluenzaA__ABW36223

SEQ ID NO: 32511 - RNA, 1698 nt, Artificial Sequence; identical to SEQ ID NO: 32426
  hemagglutinin__InfluenzaA__ABW36245

SEQ ID NO: 32512 - RNA, 1698 nt, Artificial Sequence
  hemagglutinin__InfluenzaA__ABW36267
augaaaguaaaacuacugauucuguuauguacauuuacagcuacauaugcagacacaauauguauaggcuaccaugccaacaacucgaccgacacuguugacacaguacuugagaagaaugugacagugacacauucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32513 - RNA, 1698 nt, Artificial Sequence; identical to SEQ ID NO: 32429
  hemagglutinin__InfluenzaA__ABW36278

SEQ ID NO: 32514 - RNA, 1698 nt, Artificial Sequence
  hemagglutinin__InfluenzaA__ABW36289
augaaauuaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugaaagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagggaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32515 - RNA, 1698 nt, Artificial Sequence
  hemagglutinin__InfluenzaA__ABW36300
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgcccaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcgaagugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauagggaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32516 - RNA, 1701 nt, Artificial Sequence
  hemagglutinin__InfluenzaA__ABW36311
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagcuccacuacaauuggggaaaugcagcauugccggauggaucuuaggaaacccagaaugcgaaucacuguuuucuaagaaaucaugguccuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacguaaccagaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucggaaagaaaaugcuuaugucucuguagugucuucaaauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagccuuccuuuccagaauguacacccagucacaauaggagagugcccaaaauacgucaggaguacaaaauuaaggaugguuacaggacuaagaaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauucucaugacucaaaugugaagaaucuguaugagaaaguaaaaagccaauuaaagaauaaugccaaagaaauaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32517 - RNA, 1701 nt, Artificial Sequence
  hemagglutinin__InfluenzaA__ABW38363
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguucaucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuuauuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32518 - RNA, 1698 nt, Artificial Sequence
  hemagglutinin__InfluenzaA__ABW39777
augaaaguaaaacuacugguucuguuauguacauuuacagcuacauaugcagacacaauauguauaggcuaccaugccaacaauucaaccgacacuguugacacagugcuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagaacucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaaugggaaucuaauagcgccaagguuugcuuucgcacugaguagaggcuugggaucaggaaucaucaccucaaaugcaccaauggaugaaugugaugcgaaaugucaaacaccucagggagcuauaaacagcagucuuccuuuccagaauguacacccagucacaauaggagagugucccaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggaccuauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32519 - RNA, 1698 nt, Artificial Sequence; identical to SEQ ID NO: 32418
  hemagglutinin__InfluenzaA__ABW39806

SEQ ID NO: 32520 - RNA, 1698 nt, Artificial Sequence
  hemagglutinin__InfluenzaA__ABW39817
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcgaagugucaaacaccucagggagcuauaaacagcagucuuccuuuccagaauguacacccagucacaauaggagaguguccaaaauaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaaugcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32521 - RNA, 1698 nt, Artificial Sequence
  hemagglutinin__InfluenzaA__ABW39828
augaaaguaaaacuacugguccuauuaugcacauuuacagcuacauaugcagacacaauauguaucggcuaccaugccaacaacucaaccgacacuguugacacaguacuugaaaagaaugugacagugacacacucugucaaccugcuugaggacaaccacaauggaaaacuaugucuauuaaaaggaauagccccauuacaauuggguaacugcagcguugccggguggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguauccgcaucaugcucccauaauggggaaagcagcuuuuacaaaaauuugcuauggcugacgggaaagaaugguuuguacccaaaccugagcaaguccuaugcaaacaacaaagagaaagaaguccucguacuaugggguguucaucacccgccaaacauaggugaccaaaugacccucuaucauaaagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaauucuguaauugagaagaugaacacucaauucacagcugugggcaaagaauucaacaaauuggaaagaaggauggaaaacuuaaauaaaaaaguugaugacggguuuauagacguuuggacauauaaugcagaacuguugguucuacuggaaaaugaaagaacuuuggauuuccaugacuccaaugugaagaauuuguaugagaaaguaaaaaaucaauuaaagaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32522 - RNA, 1698 nt, Artificial Sequence
  hemagglutinin__InfluenzaA__ABW39839
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuauucaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugagaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32523 - RNA, 1698 nt, Artificial Sequence
  hemagglutinin__InfluenzaA__ABW39850
augaaaguaaaacuacugguccuguuaugcacauuuacagcuacaaaugcagacacaauauguauaggcuaccaugcuaacaacucgaccgacacuguugacacaguacuugaaaagaaugugacagugacacacucugucaaucugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaucacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagccuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggauuuauagacauuuggacauauaaugcagaacuguugguucuacuggaaaaugaaaggacuuuggauuuccaugacuccaaugugaagaaucuguaugagaaaguaaaaggccaguuaaagaauaaugccaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32524 - RNA, 1698 nt, Artificial Sequence
  hemagglutinin__InfluenzaA__ABW39861
augaaaguaaaacuacugguucuguuauguacauuuacagcuacauaugcagacacaauauguauaggcuaccaugccaacaacucgaccgacacuguugacacaguacuugagaagaauguaacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacagggcuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32525 - RNA, 1701 nt, Artificial Sequence; identical to SEQ ID NO: 32445
  hemagglutinin__InfluenzaA__ABW39872

SEQ ID NO: 32526 - RNA, 1698 nt, Artificial Sequence
  hemagglutinin__InfluenzaA__ABW39883
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgcauaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuuacaguguagaauaugcaucuaa

SEQ ID NO: 32527 - RNA, 1698 nt, Artificial Sequence; identical to SEQ ID NO: 32459
  hemagglutinin__InfluenzaA__ABW39894

SEQ ID NO: 32528 - RNA, 1698 nt, Artificial Sequence
  hemagglutinin__InfluenzaA__ABW39905
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacugggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggauggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32529 - RNA, 1698 nt, Artificial Sequence; identical to SEQ ID NO: 32437
  hemagglutinin__InfluenzaA__ABW39927

SEQ ID NO: 32530 - RNA, 1701 nt, Artificial Sequence
  hemagglutinin__InfluenzaA__ABW39938
augaagacuaucauugcuuugagcuacauucuaugucugguuuucgcucaaaaaauuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacagacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgaugcauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32531 - RNA, 1698 nt, Artificial Sequence; identical to SEQ ID NO: 32494
  hemagglutinin__InfluenzaA__ABW39949

SEQ ID NO: 32532 - RNA, 1698 nt, Artificial Sequence; identical to SEQ ID NO: 32459
  hemagglutinin__InfluenzaA__ABW39960

SEQ ID NO: 32533 - RNA, 1698 nt, Artificial Sequence; identical to SEQ ID NO: 32426
  hemagglutinin__InfluenzaA__ABW39982

SEQ ID NO: 32534 - RNA, 1698 nt, Artificial Sequence
  hemagglutinin__InfluenzaA__ABW39993
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgcugacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagaccuaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacauuccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauuuuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32535 - RNA, 1698 nt, Artificial Sequence; identical to SEQ ID NO: 32430
  hemagglutinin__InfluenzaA__ABW40004

SEQ ID NO: 32536 - RNA, 1698 nt, Artificial Sequence
  hemagglutinin__InfluenzaA__ABW40015
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucauggucuuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaguuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32537 - RNA, 1701 nt, Artificial Sequence; identical to SEQ ID NO: 32491
  hemagglutinin__InfluenzaA__ABW40026

SEQ ID NO: 32538 - RNA, 1698 nt, Artificial Sequence; identical to SEQ ID NO: 32422
  hemagglutinin__InfluenzaA__ABW40037

SEQ ID NO: 32539 - RNA, 1698 nt, Artificial Sequence
  hemagglutinin__InfluenzaA__ABW40048
augaaaguaaaacuacugguucuguuauguacauuuacagcuacauaugcagacacaauauguauaggcuaccaugccaacaacucgaccgacacugucgacacaguacuugagaagaaugugacaguaacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaaaggcccucuaucauacagaaaaugcuuauguuucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcaccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagaaaggaucuggguaugcugcagaucaaaaaagcacacaaaaugccauuaacggaauuacaaacaaggugaauuccguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32540 - RNA, 1698 nt, Artificial Sequence; identical to SEQ ID NO: 32429
  hemagglutinin__InfluenzaA__ABW40059

SEQ ID NO: 32541 - RNA, 1698 nt, Artificial Sequence
  hemagglutinin__InfluenzaA__ABW40070
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuuaagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaccuaauagcgccaagauaugcuuucgcacugaguagaggcuuuggaucaggaaucaucaacucaaaugcaccaauggauaaaugugauucgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugauuccaaugugaagaaucuguaugagaaaguaaaaagccaguuaaagaauaaugccaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32542 - RNA, 1701 nt, Artificial Sequence
  hemagglutinin__InfluenzaA__ABW40081
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggggacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32543 - RNA, 1698 nt, Artificial Sequence
  hemagglutinin__InfluenzaA__ABW40092
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuuaagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuccuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32544 - RNA, 1698 nt, Artificial Sequence; identical to SEQ ID NO: 32461
  hemagglutinin__InfluenzaA__ABW40103

SEQ ID NO: 32545 - RNA, 1698 nt, Artificial Sequence
  hemagglutinin__InfluenzaA__ABW40114
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucagugucuucauuugagagguucgaaauauuccccaaagagagcucauggcccaaccacaccguaaccggaguaucaacaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauagggaaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32546 - RNA, 1698 nt, Artificial Sequence
  hemagglutinin__InfluenzaA__ABW40125
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcaccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32547 - RNA, 1701 nt, Artificial Sequence
  hemagglutinin__InfluenzaA__ABW40136
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguucuucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuugaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32548 - RNA, 1698 nt, Artificial Sequence; identical to SEQ ID NO: 32449
  hemagglutinin__InfluenzaA__ABW40147

SEQ ID NO: 32549 - RNA, 1698 nt, Artificial Sequence
  hemagglutinin__InfluenzaA__ABW40158
augaaaguaaaacuauugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccaucgccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32550 - RNA, 1698 nt, Artificial Sequence; identical to SEQ ID NO: 32418
  hemagglutinin__InfluenzaA__ABW40180

SEQ ID NO: 32551 - RNA, 1701 nt, Artificial Sequence
  hemagglutinin__InfluenzaA__ABW40191
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32552 - RNA, 1698 nt, Artificial Sequence
  hemagglutinin__InfluenzaA__ABW40202
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucugauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32553 - RNA, 1698 nt, Artificial Sequence; identical to SEQ ID NO: 32430
  hemagglutinin__InfluenzaA__ABW40213

SEQ ID NO: 32554 - RNA, 1698 nt, Artificial Sequence; identical to SEQ ID NO: 32430
  hemagglutinin__InfluenzaA__ABW40224

SEQ ID NO: 32555 - RNA, 1698 nt, Artificial Sequence; identical to SEQ ID NO: 32418
  hemagglutinin__InfluenzaA__ABW40235

SEQ ID NO: 32556 - RNA, 1701 nt, Artificial Sequence
  hemagglutinin__InfluenzaA__ABW40246
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucagaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32557 - RNA, 1698 nt, Artificial Sequence
  hemagglutinin__InfluenzaA__ABW40257
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuauaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32558 - RNA, 1701 nt, Artificial Sequence
  hemagglutinin__InfluenzaA__ABW40268
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32559 - RNA, 1698 nt, Artificial Sequence
  hemagglutinin__InfluenzaA__ABW40312
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggagaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuauguuucuguaguuucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32560 - RNA, 1701 nt, Artificial Sequence
  hemagglutinin__InfluenzaA__ABW40323
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32561 - RNA, 1698 nt, Artificial Sequence
  hemagglutinin__InfluenzaA__ABW40334
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagacgguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32562 - RNA, 1698 nt, Artificial Sequence
  hemagglutinin__InfluenzaA__ABW40345
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucauggucuuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccaaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucacuucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaaggaggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaguuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32563 - RNA, 1698 nt, Artificial Sequence
  hemagglutinin__InfluenzaA__ABW40356
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugaaaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguaaugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuacccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32564 - RNA, 1698 nt, Artificial Sequence
  hemagglutinin__InfluenzaA__ABW40367
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccacagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32565 - RNA, 1701 nt, Artificial Sequence; identical to SEQ ID NO: 32445
  hemagglutinin__InfluenzaA__ABW40378

SEQ ID NO: 32566 - RNA, 1698 nt, Artificial Sequence
  hemagglutinin__InfluenzaA__ABW40389
augaaaguaaaacuacuaguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuuugccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaacucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32567 - RNA, 1698 nt, Artificial Sequence; identical to SEQ ID NO: 32424
  hemagglutinin__InfluenzaA__ABW40400

SEQ ID NO: 32568 - RNA, 1698 nt, Artificial Sequence; identical to SEQ ID NO: 32430
  hemagglutinin__InfluenzaA__ABW40411

SEQ ID NO: 32569 - RNA, 1698 nt, Artificial Sequence; identical to SEQ ID NO: 32430
  hemagglutinin__InfluenzaA__ABW40422

SEQ ID NO: 32570 - RNA, 1698 nt, Artificial Sequence
  hemagglutinin__InfluenzaA__ABW40433
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacaucguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucuugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32571 - RNA, 1698 nt, Artificial Sequence
  hemagglutinin__InfluenzaA__ABW40444
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaaggaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32572 - RNA, 1698 nt, Artificial Sequence; identical to SEQ ID NO: 32451
  hemagglutinin__InfluenzaA__ABW40455

SEQ ID NO: 32573 - RNA, 1698 nt, Artificial Sequence; identical to SEQ ID NO: 32429
  hemagglutinin__InfluenzaA__ABW40466

SEQ ID NO: 32574 - RNA, 1698 nt, Artificial Sequence; identical to SEQ ID NO: 32465
  hemagglutinin__InfluenzaA__ABW40477

SEQ ID NO: 32575 - RNA, 1698 nt, Artificial Sequence; identical to SEQ ID NO: 32489
  hemagglutinin__InfluenzaA__ABW40488

SEQ ID NO: 32576 - RNA, 1698 nt, Artificial Sequence; identical to SEQ ID NO: 32429
  hemagglutinin__InfluenzaA__ABW40499

SEQ ID NO: 32577 - RNA, 1698 nt, Artificial Sequence
  hemagglutinin__InfluenzaA__ABW40510
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32578 - RNA, 1698 nt, Artificial Sequence; identical to SEQ ID NO: 32486
  hemagglutinin__InfluenzaA__ABW40521

SEQ ID NO: 32579 - RNA, 1698 nt, Artificial Sequence; identical to SEQ ID NO: 32429
  hemagglutinin__InfluenzaA__ABW40532

SEQ ID NO: 32580 - RNA, 1698 nt, Artificial Sequence
  hemagglutinin__InfluenzaA__ABW40543
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugacuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcaaauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucuacuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaaggauggaaaacuuaaauaaaaagguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggauguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32581 - RNA, 1698 nt, Artificial Sequence; identical to SEQ ID NO: 32559
  hemagglutinin__InfluenzaA__ABW40554

SEQ ID NO: 32582 - RNA, 1698 nt, Artificial Sequence; identical to SEQ ID NO: 32418
  hemagglutinin__InfluenzaA__ABW40565

SEQ ID NO: 32583 - RNA, 1698 nt, Artificial Sequence
  hemagglutinin__InfluenzaA__ABW40576
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaauacuuaugucucuguagugucuucacauuauagcagaagauucaccccagaaauagccaaaagacccaaggugagagaucaggaaggaagaaucaacuacuacuggacucugcuugaacccggggauacaauaauacuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucguugcaguguagaauaugcaucuaa

SEQ ID NO: 32584 - RNA, 1701 nt, Artificial Sequence
  hemagglutinin__InfluenzaA__ABW40587
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuaccgagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32585 - RNA, 1698 nt, Artificial Sequence
  hemagglutinin__InfluenzaA__ABW40598
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucauggucuuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucacuucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaaggaggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaguuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32586 - RNA, 1698 nt, Artificial Sequence
  hemagglutinin__InfluenzaA__ABW40609
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaaggaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32587 - RNA, 1698 nt, Artificial Sequence; identical to SEQ ID NO: 32524
  hemagglutinin__InfluenzaA__ABW40620

SEQ ID NO: 32588 - RNA, 1701 nt, Artificial Sequence; identical to SEQ ID NO: 32558
  hemagglutinin__InfluenzaA__ABW40631

SEQ ID NO: 32589 - RNA, 1698 nt, Artificial Sequence
  hemagglutinin__InfluenzaA__ABW40642
augaaaguaaaacuacugauucuguuauguacauuuacagccacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacauuccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32590 - RNA, 1701 nt, Artificial Sequence; identical to SEQ ID NO: 32558
  hemagglutinin__InfluenzaA__ABW40653

SEQ ID NO: 32591 - RNA, 1698 nt, Artificial Sequence; identical to SEQ ID NO: 32577
  hemagglutinin__InfluenzaA__ABW40664

SEQ ID NO: 32592 - RNA, 1698 nt, Artificial Sequence
  hemagglutinin__InfluenzaA__ABW40675
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32593 - RNA, 1698 nt, Artificial Sequence
  hemagglutinin__InfluenzaA__ABW71294
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguaaugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccgaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32594 - RNA, 1698 nt, Artificial Sequence
  hemagglutinin__InfluenzaA__ABW71305
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucuugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32595 - RNA, 1698 nt, Artificial Sequence
  hemagglutinin__InfluenzaA__ABW71316
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccagggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32596 - RNA, 1698 nt, Artificial Sequence; identical to SEQ ID NO: 32440
  hemagglutinin__InfluenzaA__ABW71327

SEQ ID NO: 32597 - RNA, 1698 nt, Artificial Sequence
  hemagglutinin__InfluenzaA__ABW71338
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgcugacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggauuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32598 - RNA, 1701 nt, Artificial Sequence; identical to SEQ ID NO: 32472
  hemagglutinin__InfluenzaA__ABW71349

SEQ ID NO: 32599 - RNA, 1698 nt, Artificial Sequence
  hemagglutinin__InfluenzaA__ABW71360
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuucagaauguacacccagucacaauaggagaguguccaaaguaugucaggagugcaaaauuaagaaugguuacaggacuaaggaacaucccauccauucaauccagagguuuguuuggagccauugccgguuucauugaagggggauggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaagugugacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32600 - RNA, 1698 nt, Artificial Sequence; identical to SEQ ID NO: 32592
  hemagglutinin__InfluenzaA__ABW71371

SEQ ID NO: 32601 - RNA, 1698 nt, Artificial Sequence
  hemagglutinin__InfluenzaA__ABW71382
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucaugguccaaccacaccauaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32602 - RNA, 1698 nt, Artificial Sequence
  hemagglutinin__InfluenzaA__ABW71393
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucaccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32603 - RNA, 1698 nt, Artificial Sequence
  hemagglutinin__InfluenzaA__ABW71404
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguaaugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32604 - RNA, 1698 nt, Artificial Sequence
  hemagglutinin__InfluenzaA__ABW71415
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauagugggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggggaguguccaaaguaugucaggagugcaaaauuaagaaugguuacaggacuaaggaacaucccauccauucaaucccgagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32605 - RNA, 1698 nt, Artificial Sequence
  hemagglutinin__InfluenzaA__ABW71426
augaaagcaaaacuacugauucuguuauguacauuuacagcuacauaugcagacacaauauguauagguuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuagaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32606 - RNA, 1698 nt, Artificial Sequence
  hemagglutinin__InfluenzaA__ABW71448
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacaaucgccaguucccugguucuuuuggucucccugggggcaaucagcuucuggauguguuccaaugggucuuugcaguguagaauaugcaucuaa

SEQ ID NO: 32607 - RNA, 1698 nt, Artificial Sequence; identical to SEQ ID NO: 32571
  hemagglutinin__InfluenzaA__ABW71459

SEQ ID NO: 32608 - RNA, 1698 nt, Artificial Sequence
  hemagglutinin__InfluenzaA__ABW71470
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucauccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32609 - RNA, 1707 nt, Artificial Sequence
  hemagglutinin__InfluenzaA__ABW74702
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauauuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaccuauugagcagaauaaaccauuuugagaaaauucagaucauccccaaaaguucuugguccgaucaugaagccucaucaggagugaguucagcauguccauaccuggguaguuccuccuuuuuuagaaaugugguauggcuuaucaaaaagaacaguacauacccaacaauaaagaaaagcuacaauaauaccaaccaagaagaucuuuugguacugugggggauucaccauccuaaugaugcggcagagcagacaaggcuauaucaaaacccaaccaccuauauuuccauugggacaucaacacuaaaccagagauugguaccaaaaauagcuacuagauccaaaguaaaugggcaaaguggaaggauggaguucuucuggacaauuuuaaaaccuaaugaugcaaucaacuucgagaguaauggaaauuucauugcuccagaauaugcauacaaaauugucaagaaaggggacucagcaauuaugaagagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagaaagcagaagaaaaaagagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucaaucauugacaaaaugaacacucaguuugaggccguuggaagggaauuuaacaacuuagaaaggagaauagagaauuuaaacaagaagauggaagacggguuucuagaugucuggacuuauaaugccgaacuucugguucucauggaaaaugagagaacucuagacuuucaugacucaaauguuaagaaccuauacgacaagguccgacuacagcuuagggauaaugcaaaggagcugggcaacgguuguuucgaguucuaucacaaaugugauaaugaauguauagaaaguauaagaaauggaacauauaacuacccgcaguauucagaagaagcaagauuaaaaagagaggaaauaaguggaguaaaauuggaaucaauaggaacuuaccaaauacugucaauuuauucaacaguggcgaguucccuagcacuggcaaucaugauggcuggucuaucuuuauggaugugcuccaauggaucguuacaaugcagaauuugcauuuaa

SEQ ID NO: 32610 - RNA, 1707 nt, Artificial Sequence
  hemagglutinin__InfluenzaA__ABW74703
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaaaagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaccuauugagcagaauaaaccauuuugagaaaauucaaaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccacccuaaugaugcggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccuaaugaugcagucaacuucgagaguaauggaaauuucauugcuccagaauaugcauacaaaauugucaagaaaggggacucagcaauuaugaaaagugaauuggaauaugguaacuguaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggacuauuuggagcuauagcagguuuuauagagggaggauggcaggguaugguagaugguugguauggguaccaccauagcaaugagcaggggaguggguacgcugcagacaaagaauccacucaaaaggcaauagauggagucaccaauaaggucaacucaaucauugacaaaaugaacacucaguuugaggccguuggaagggaauuuaauagcuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuacgacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguggcgaguucccuagcacuggcaaucaugauagcuggucuaucuuuauggaugugcuccaauggaucguuacagugcagaauuugcauuuaa

SEQ ID NO: 32611 - RNA, 1707 nt, Artificial Sequence
  hemagglutinin__InfluenzaA__ABW74705
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaucuauugagcagaauaaaccauuuugagaaaauucaaaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaaugaugcggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccuaaugaugcaaucaacuucgaaaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucaauuauugacaaaaugaacacucaguuugaggcuguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuacgacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauugaaaagagaggaaauaagugggguaaaauuggaaucaauaggaacuuaccaaauacugucaauuuauucaacaguggcgaguucccuagcacuggcaaucaugauagcuggucuaucuuuauggaugugcuccaauggaucguuacaaugcagaauuugcauuuaa

SEQ ID NO: 32612 - RNA, 1707 nt, Artificial Sequence
  hemagglutinin__InfluenzaA__ABW74707
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaccuauugagcagaauaaaccauuuugagaaaauucaaaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaaugaugcggcagagcagacaaggcuauaucaaaacccaaccaccuauauuuccauugggacaucaacacuaaaccagagauugguaccaaaaauggcuacuagauccaaaguaaacgggcaaaguggaaggauggaguucuucuggacaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccaaugggggcgauaaacucuaguaugccauuccacaacauacacccucucaccaucggggaaugccccaaauaugugaaaucaaacagauuaguccuugcaacagggcucagaaauagcccucaaagagagagcagaagaaaaaagagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucaauuauugacaaaaugaacacucaguuugaggccguuggaagggaauuuaauaacuuagaaaggagaauagagaauuuaaacaagaagauggaagacggguuucuagauguuuggacuuauaaugccgaacuucugguucucauggaaaaugagagaacucuagacuuucaugacucaaauguuaagaaccucuacgacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguggcgaguucccuagcacuggcaaucaugauagcuggucuaucuuuauggaugugcuccaauggaucguuacaaugcagaauuugcauuuaa

SEQ ID NO: 32613 - RNA, 1707 nt, Artificial Sequence
  hemagglutinin__InfluenzaA__ABW74708
auggagaaaauagugcuucuucuugcaauagucagucuuguuaaaagugaucagauuugcauugguuaccaugcaaacaauucaacagagcagguugacacaaucauggaaaagaacguuacuguuacacaugcccaagacauacuggaaaagacacacaaugggaagcucugcgaucuagauggagugaagccucuaauuuuaagagauuguaguguagcuggauggcuccucgggaacccaaugugugacgaauucaucaauguaccggaauggucuuacauaguggagaaggccaauccaaccaaugaccucuguuacccagggaguuucaacgacuaugaagaacugaaacaccuauugagcagaauaaaccauuuugagaaaauucaaaucauccccaaaaguucuugguccgaccaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaaugaugcggcagagcagacaaggcuauaucaaaacccaaccaccuauauuuccauugggacaucaacacuaaaccagagauugguaccaaaaauagcuacuagauccaaaguaaacgggcaaaguggaaggauggaguucuucuggacaauuuuaaaaccuaaugaugcaaucaacuucgagaguaauggaaauuucauugcuccagaauaugcauacaaaauugucaagaaaggggacucagcaauuaugaaaagugaauuggaauaugguaacugcaacaccaagugucaaacuccgaugggggcgauaaacucuaguaugccauuccacaacauacacccucucaccaucggggaaugccccaaauaugugaaaucaaacagaucaguccuugcaacagggcucagaaauagcccucaaagagagagcagaagaaaaaagagaggacuauuuggagcuauagcagguuuuauagagggaggauggcagggaaugguagaugguugguauggguaccaccauagcaaugagcaggggaguggauacgcugcagacaaagaauccacucaaaaggcaauagauggagucaccaauaaggucaacucaaucauugacaaaaugaacacucaguuugaggccguuggaagggaauuuaauaacuuagaaaggagaauagagaauuuaaacaagaagauggaagacggguuucuagauguuuggacuuauaaugccgagcuucugguucucauggaaaaugagagaacucuagacuuucaugacucaaauguuaagaaccucuacgacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaauuggaaucaauaggaacuuaccaaauacugucaauuuauucaacaguggcgaguucccuagcacuggcaaucaugauggcuggucuauccuuauggaugugcuccaauggaucguuacaaugcagaauuugcauuuaa

SEQ ID NO: 32614 - RNA, 1707 nt, Artificial Sequence; identical to SEQ ID NO: 32611
  hemagglutinin__InfluenzaA__ABW74710

SEQ ID NO: 32615 - RNA, 1707 nt, Artificial Sequence; identical to SEQ ID NO: 32611
  hemagglutinin__InfluenzaA__ABW74711

SEQ ID NO: 32616 - RNA, 1707 nt, Artificial Sequence
  hemagglutinin__InfluenzaA__ABW74712
auggagaaaauagugcuucuucuuucaauagucagucuuguuaaaagugaucagauuugcauugguuaccaugcaaacaauucaacagagcagguugacacaaucauggaaaagaacguuacuguuacacaugcccaagacauacuggaaaagacacacaacgggaagcucugcgaucuagauggagugaagccucuaauuuuaagagauuguaguguagcuggauggcuccucgggaacccaaugugugacgaauucaucaacguaccggaauggucuuacauaguggaaaaggccaauccaaccaaugaccucuguuacccagggaguuucaacgacuaugaagaacugaaacaccuauugagcagaauaaaccauuuugagaaaauucagaucauccccaaaaguucuugguccgaucaugaagccucaucaggagugagcucagcauguccauaccugggaagucccuccuuuuuuagaaaugugguauggcuuaucaaaaagaacaguacauacccaacaauaaagaaaagcuacaauaauaccaaccaagaagaucuuuugguacuguggggaauucaccauccuaauaaugaggaagagcagacaaggcuauaucaaaacccaaccaccuauauuuccauugggacaucaacacuaaaccagagauugguaccaaaaauagcuacuagauccaaaguaaacgggcaaagugggaggauggaguucuucuggacaauuuuaaaaccaaaugaugcaaucaacuucgagagcaauggaaauuucauugcuccagaauaugcauacaaaauugucaagaaaggggacucagcaauuaugaaaagugaauuggaauauaguaacugcaacaccaagugucaaacuccaaugggggcgauaaacucuaguaugccauuccacaacauacacccucucaccaucggggaaugccccaaauaugugaaaucaagcagauuaguccuugcaacagggcucagaaauagcccucaaagagagagcagaagaaaaaagagaggucuauuuggagcuauagcagguuuuauagagggaggauggcagggaaugguagaugguugguauggguaccaccauagcaaugagcaggggaguggguacgcugcagacaaagaaucuacucaaaaggcaauagauggagucaccaauaaggucaacucaauuauugacaaaaugaacacucaguuugaggccguuggaagggaauuuaauaacuuagaaaggagaauagagaauuuaaacaagaagauggaagacggguuucuagauguuuggacuuauaaugccgaacuucugguccucauggaaaaugagagaacucuagacuuucaugacucaaauguuaagaaccucuaugacaagguccgacuacagcuuagggauaaugcaaaggagcuggguaacgguuguuucgaguucuaucacaaaugugauaaugaauguauggaaaguauaagaaacggaacguacaacuauccgcaguauucagaagaagcaagauuaaaaagagaggaaauaagugggguaaaguuggaaucaauaggaacuuaccaaauacugucaauuuacucaacaguggcgaguucccuagcacuggcaaucaugauagcuggucuaucuuuauggaugugcuccaauggaucguuacaaugcagaauuugcauuuaa

SEQ ID NO: 32617 - RNA, 1701 nt, Artificial Sequence
  hemagglutinin__InfluenzaA__ABW80976
augaagacuaucauugcuuugagcuacauuuuaugccugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguucuucaacaaguagaauaugcgacaguccucaccaaauccuugauggagaaaauugcacacuaauagaugcucuauugggagacccucauugugauggcuuccaaaauaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagaucugauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagcauauaugcucaagcaucagggagagucacagucucuaccaaaagaagccaacaaacuguaaucccgaauaucggaucuagacccuggguaaggggugucuccagcggaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggugcaaucgcgggcuucauagaaaaugguugggagggaaugauggacgguugguacgguuucaggcaucaaaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauauguugaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuugcugggguucaucaugugggccugccaaaaaggcaacauuaggugcaacauuugcauuuga

SEQ ID NO: 32618 - RNA, 1701 nt, Artificial Sequence
  hemagglutinin__InfluenzaA__ABW80977
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaaaaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucaaccuauaugcucaagcaucaggaagaaucacagucucuaccaaaagaagccaacaaacuguaaucccgaauaucggaucuagacccagaguaagggauguccccagcagaauaagcaucuauuggacaauaguaaaaccgggagacauacuuuugauuagcagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggaacaggacaagcagcagaucucaaaagcacucaagcagcaaucaaccaaaucaaugggaagcugaauagguugaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32619 - RNA, 1698 nt, Artificial Sequence
  hemagglutinin__InfluenzaA__ABW80979
augaaagcaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuauguaaacaacaaagagaaagaaguccuuguacuaugggguguucaucacccgccuaacauagggaaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaaccuggggauacaauaauauuugaggcaaauggaaaucuaauagcgccaugguaugcuuuugcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaaguacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32620 - RNA, 1701 nt, Artificial Sequence
  hemagglutinin__InfluenzaA__ABW81505
augaaagcaaaacuacuaguucuguuguguacauuuacagcuacauaugcagacacaauauguauaggcuaccaugcgaacaacucaacugacacuguugacacaguacuugagaagaacgugacagugacacacucugucaaccuacuugaggacagucacaauggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaaaaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaaugcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaagaacuuuggauuuucaugacucaaaugugaagaaccuguaugagaaagugaaaacccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucucugcaguguagaauaugcaucuga

SEQ ID NO: 32621 - RNA, 1698 nt, Artificial Sequence
  hemagglutinin__InfluenzaA__ABW81506
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucuuggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauagggaaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggaaucuaucagauucuggcgaucuacucaacugucgccaguucccugguucuuuuggucucccugggggcaaucagcuucuggauguguuccaaugggucuuugcaguguagaauaugcaucuga

SEQ ID NO: 32622 - RNA, 1701 nt, Artificial Sequence
  hemagglutinin__InfluenzaA__ABW81507
augaaagcaaaacuacuaguucuguuguguacauuuacagcuacauaugcagacacaauauguauaggcuaccaugcgaacaacucaacugacacuguugacacaguacuugagaagaacgugacagugacacacucugucaaccuacuugaggacagucacaauggaaaacuaugccgacuaaaaggaacagucccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccgaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaaaaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaaugcaucaaugggugaaugugacgcuaagugucaaacaccccaaggagcuauaaacaguagucuccccuuccagaauguacacccagucacaauaggagaguguccaaaguaugucaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaacccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 32623 - RNA, 1698 nt, Artificial Sequence
  hemagglutinin__InfluenzaA__ABW81508
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacagaaauuugcuauggcugacgaggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaacccggggauacaauaauauuugaggcaaauggaaaucuaauagcgccaagguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32624 - RNA, 1701 nt, Artificial Sequence
  hemagglutinin__InfluenzaA__ABW81509
augaaagcaaaacuacuaguucuguuguguacauuuacagcuacauaugcagacacaauauguauaggcuaccaugcgaacaacucaacugacacuguugacacaguacuugagaagaacgugacagugacacacucugucaaccuacuugaggacagucacaauggaaaacuaugccgacuaaaaggaacagccccacuacaauuggguaauugcagcauugccggauggaucuuaggaaauccagaaugcgaaucacuguuuucuaaggaaucauggucuuacauugcagaaacaccaaacccuaaaaauggaacauguuacccaggguauuucgccgacuaugaggaacugagggagcaauugagcucaguaucaucauucgagagauuugaaauauuccccaaggauagcucauggcccaaccacacuguaaccaaaggagugacggcaucaugcucccauaaugggaaaagcagcuuuuacaaaaauuugcuauggcugacggagaagaauggcuuguacccaaaucugagcaaguccuauguaaacaaaaagggaaaagaaguccuugugcuaugggguguucaucacccgucuaacaugggggaccaacgggccaucuaucauaaagaaaaugcuuauguuucuguguugucuucacauuauagcagaagauucaccccagaaauagcaaaaagaccaaaaguaagagaucaagaagggagaauuaacuacuacuggacucugcuggaacccggggacacaauaauauuugaggcaaauggaaaucuaauagcgccgugguacgcuuucgcacugaguagaggcuuugggucaggaaucaucaucucaaaugcaucaaugggugaaugugacgcuaagugucaaacaccccaaggagcuauaaacaguagucuccccuuccagaauguacacccagucacaauaggagaguguccaaaguauguuaggaguacaaaauuaaggaugguuacaggacuaaggaacgucccauccauucaauccagagguuuguuuggagccauugccgguuucauugaaggaggguggacuggaaugauagauggaugguaugguuaucaucaucaaaaugaacaaggaucuggcuaugcugcggaccaaaaaagcacacaaaaugccauuaaugggauuacaaacaaggugaauucuauaaucgagaaaaugaacacucaauucacagcuguaggcaaagaauucaacaaauuagaaagaaggauggaaaacuuaaauaagaaaguugaugauggauuucuggacauuuggacauauaaugcagaauuguuaguucuccuggaaaaugaaaggacuuuggauuuucaugacucaaaugugaagaaccuguaugagaaagugaaaacccaauugaagaauaaugccaaagaaauagggaacggguguuuugaauucuaucacaaguguaacaaugaaugcauggaaagugugaaaaauggaacuuaugacuauccaaaauauuccaaagaaucaaaguuaaacagggaaaaaauugauggagugaaauuggaaucaaugggagucuaucagauucuggcgaucuacucaacugucgccaguucgcuggugcuuuuggucucccugggggcaaucagcuucuggauguguucuaaugggucuuugcaguguagaauaugcaucuga

SEQ ID NO: 32625 - RNA, 1698 nt, Artificial Sequence
  hemagglutinin__InfluenzaA__ABW81511
augaaagcaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauagggaaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacucaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32626 - RNA, 1698 nt, Artificial Sequence
  hemagglutinin__InfluenzaA__ABW81512
augaaagcaaaacuacugguccuguuauguacauuuacagcuacauacgcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaaucccgagaauggaacauguuacccaggguauuucgccgacuaugaggaacugagggagcaauugaguucaguaucuucauuugagagauucgaaauauuccccaaaggaagcucauggcccaaccacaccguaaccggaguaucagcaucaugcucccauaaugggaaaagcaguuuuuacagaaauuugcuauggcugacggggaagaaugguuuguacccaaaccugagcauguccuauguaaacaacaaagagaaagaaguccuugugcuaugggguguucaucacccaccuaacauaggggaccaaagggcccucuaccauacagaaaaugcuuaugucucuguagugucuucacauuauagcagaagauucaccccagaaauagccaaaagacccaaaguaagagaucaggaaggaagaaucaacuacuacuggacucugcuggaacccggggacacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacaguagucuuccuuuccagaauguacacccaguuacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuagaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggaaagugugaaaaauggaacuuaugacuauccaaaauauuccgaagaaucaaaguuaaacagggagaaaauugauggaguaaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32627 - RNA, 1698 nt, Artificial Sequence
  hemagglutinin__InfluenzaA__ABW81513
augaaaguaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguaguaucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32628 - RNA, 1698 nt, Artificial Sequence
  hemagglutinin__InfluenzaA__ABW81514
augaaaguaaaacuacugguucuguuauguacauuuacagcuacauaugcagacacaauauguauaagcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaauggcuuguacccaaaccugagcaaguccuaugcaaacaacaaagagaaagaaguccuuguacuaugggguguucaucacccgccuaacauaggggaccaaagggcccucuaucauacagaaaaugcuuaugucucugucgugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32629 - RNA, 1698 nt, Artificial Sequence
  hemagglutinin__InfluenzaA__ABW81515
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32630 - RNA, 1698 nt, Artificial Sequence
  hemagglutinin__InfluenzaA__ABW81516
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuauugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaauggcuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32631 - RNA, 1698 nt, Artificial Sequence
  hemagglutinin__InfluenzaA__ABW81517
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaauaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaauggcuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32632 - RNA, 1698 nt, Artificial Sequence
  hemagglutinin__InfluenzaA__ABW81518
augaaaguaaaacuacugguucuguuauguacauauacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguaguaucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32633 - RNA, 1698 nt, Artificial Sequence
  hemagglutinin__InfluenzaA__ABW81519
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcucaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucacuucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaguugaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32634 - RNA, 1698 nt, Artificial Sequence
  hemagglutinin__InfluenzaA__ABW81520
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaguugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguaguaucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32635 - RNA, 1698 nt, Artificial Sequence
  hemagglutinin__InfluenzaA__ABW81521
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaauggcuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucuccucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32636 - RNA, 1698 nt, Artificial Sequence
  hemagglutinin__InfluenzaA__ABW81522
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaauggcuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32637 - RNA, 1698 nt, Artificial Sequence
  hemagglutinin__InfluenzaA__ABW81523
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguaguaucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32638 - RNA, 1698 nt, Artificial Sequence
  hemagglutinin__InfluenzaA__ABW81524
augaaaguaaaacuacugguucuguuauguacauuuacagcuacauaugcagacacaauauguauaggcuaccaugccaacaacucaaccgacacuauugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuauccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaauggcuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32639 - RNA, 1698 nt, Artificial Sequence
  hemagglutinin__InfluenzaA__ABW81526
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggguaaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauuccguaauugagaaaaugaacacucaauucacagcagugggcaaagaauucaacaaauuggaaagaaggauggaaaacuuaaauaaaaaaguugaugauggguuuauagacauuuggacauauaaugcagaacuguugguucuacuggaaaaugaaaggacuuuggaucuccaugacuccaaugugaagaaucuguaugagaaaguaaaaagccaguuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32640 - RNA, 1698 nt, Artificial Sequence
  hemagglutinin__InfluenzaA__ABW81527
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaaugggaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacucugcuggaacccggggauacaauaauauucgaggcaaauggaaaucuaauagcaccaagguuugcuuucgcacugaguagaggcuuuggaucaggaaucaucaccucaaaugcaccaauggaugaaugugaugcgaagugucaaacaccucagggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaaggggguuggacuggaaugguagaugguugguaugguuaucaucaucagaaugagcaagggucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacgggugcuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32641 - RNA, 1698 nt, Artificial Sequence
  hemagglutinin__InfluenzaA__ABW81528
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccagggcauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuucuacagaaauuugcuauggcugacggggaagaaugguuuguauccaaaccugagcaaguccuaugcaaacaacaaagagaaagaaguccuuguacugugggguauucaucacccgccuaacauaggggaccaaagggcccucuaucauacagaaaaugcuuaugucucuguagugucuucacauuauagcagaagauucaccccagaaauagccaaaagacccaagguaagagaucaggaaggaagaaucaacuacuacuggacucuucuggaacccagggauacaauaauauuugaggcaaauggaaaucuaauagcaccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagaggucuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuagaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32642 - RNA, 1698 nt, Artificial Sequence
  hemagglutinin__InfluenzaA__ABW81529
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccccuacaauuggguaauugcagcguugccggauggaucuuaggaaacccagaaugcgaauuacugauuuccagggaaucaugguccuacauuguagaaacaccaaauccugagaauggaacauguuacccaggguauuucgccgacuaugaggagcuaagggagcaauugaguucaguaucuucauuugagagauucgaaauauuccccaaagaaagcucauggcccaaccacaccguaaccggagugucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaccacccgccuaacauaagggaccaaaugacccucuaucauacagaaaaugcuuaugucucgguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccuaagggagcuauaaacagcagucuuccuuuccagaauguacauccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaaagucgaugauggguuucuagacauuuggacauauaaugcugaauuguugguucuacuggaaaaugaaaggacuuuggauuuccacgacuccaaugugaagaaucuguaugagaaaguaaaaagccaauuaaagaauaaugccaaagaaauaggaaauggguguuuugaauucuaucacaaguguaacaacgaaugcauggagaguguuaaaaauggaacuuaugacuauccaaaauauuccgaagaaucaaaguuaaacagggaaaaaauugauggagugaaauuggaaucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 32643 - RNA, 1698 nt, Artificial Sequence
  hemagglutinin__InfluenzaA__ABW81530
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacaggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 32644 - RNA, 1698 nt, Artificial Sequence; identical to SEQ ID NO: 30830
  hemagglutinin__InfluenzaA__ABW81531

SEQ ID NO: 32645 - RNA, 1698 nt, Artificial Sequence
  hemagglutinin__InfluenzaA__ABW81532
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaugguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauagggaaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 32646 - RNA, 1698 nt, Artificial Sequence; identical to SEQ ID NO: 32463
  hemagglutinin__InfluenzaA__ABW86321

SEQ ID NO: 32647 - RNA, 1698 nt, Artificial Sequence
  hemagglutinin__InfluenzaA__ABW86332
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcaaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32648 - RNA, 1698 nt, Artificial Sequence; identical to SEQ ID NO: 32430
  hemagglutinin__InfluenzaA__ABW86343

SEQ ID NO: 32649 - RNA, 1698 nt, Artificial Sequence; identical to SEQ ID NO: 32418
  hemagglutinin__InfluenzaA__ABW86354

SEQ ID NO: 32650 - RNA, 1698 nt, Artificial Sequence; identical to SEQ ID NO: 32494
  hemagglutinin__InfluenzaA__ABW86365

SEQ ID NO: 32651 - RNA, 1698 nt, Artificial Sequence
  hemagglutinin__InfluenzaA__ABW86376
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggagaguguccaaaguaugucaggagugcaaaauuaagaaugguuacaggacuaaggaacaucccaucaauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32652 - RNA, 1698 nt, Artificial Sequence; identical to SEQ ID NO: 32494
  hemagglutinin__InfluenzaA__ABW86387

SEQ ID NO: 32653 - RNA, 1698 nt, Artificial Sequence; identical to SEQ ID NO: 32430
  hemagglutinin__InfluenzaA__ABW86409

SEQ ID NO: 32654 - RNA, 1698 nt, Artificial Sequence; identical to SEQ ID NO: 32489
  hemagglutinin__InfluenzaA__ABW86431

SEQ ID NO: 32655 - RNA, 1698 nt, Artificial Sequence; identical to SEQ ID NO: 32418
  hemagglutinin__InfluenzaA__ABW86442

SEQ ID NO: 32656 - RNA, 1698 nt, Artificial Sequence
  hemagglutinin__InfluenzaA__ABW86453
augaaaguaaaacuacuuguucuguuauguacauuuacagcuacauaugcagacacaauauguauaggcuaccaugccaacaacucgaccgacacuguugacacagugcuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauccuggcgaucuacucaacagucgccaguucccugguucuuuuggucucccugggggcaaucagcuucuggauguguuccaaugggucuuugcaguguagaauaugcaucuaa

SEQ ID NO: 32657 - RNA, 1698 nt, Artificial Sequence
  hemagglutinin__InfluenzaA__ABW86464
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccaucaauucaauccagaggcuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32658 - RNA, 1698 nt, Artificial Sequence; identical to SEQ ID NO: 32571
  hemagglutinin__InfluenzaA__ABW86475

SEQ ID NO: 32659 - RNA, 1698 nt, Artificial Sequence
  hemagglutinin__InfluenzaA__ABW86486
augaaaguaaaacuacugauucuguuauguacauuuaccgcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaagggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaaucaagagguuuauuuggagccauugcugguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32660 - RNA, 1698 nt, Artificial Sequence
  hemagglutinin__InfluenzaA__ABW86497
augaaagugaaacuacugguucuguuauguacauuuacagcuacauaugcggacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaacggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacauuccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32661 - RNA, 1698 nt, Artificial Sequence; identical to SEQ ID NO: 32429
  hemagglutinin__InfluenzaA__ABW86508

SEQ ID NO: 32662 - RNA, 1698 nt, Artificial Sequence
  hemagglutinin__InfluenzaA__ABW86519
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaggagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagaaaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggggaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32663 - RNA, 1698 nt, Artificial Sequence; identical to SEQ ID NO: 32424
  hemagglutinin__InfluenzaA__ABW86530

SEQ ID NO: 32664 - RNA, 1698 nt, Artificial Sequence
  hemagglutinin__InfluenzaA__ABW86541
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucugcuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcucaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaaggaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32665 - RNA, 1698 nt, Artificial Sequence
  hemagglutinin__InfluenzaA__ABW86552
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugaaaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32666 - RNA, 1701 nt, Artificial Sequence
  hemagglutinin__InfluenzaA__ABW86563
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggacacaaagauuggauccuauggauuuccuuugccauaucauguuucuugcuuuguguugcuuuguugggguucaucaugugggccugccaaaaaggcaacauuaggugcaacauuugcaucuga

SEQ ID NO: 32667 - RNA, 1698 nt, Artificial Sequence; identical to SEQ ID NO: 32451
  hemagglutinin__InfluenzaA__ABW86606

SEQ ID NO: 32668 - RNA, 1701 nt, Artificial Sequence
  hemagglutinin__InfluenzaA__ABW91185
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacaaucacaacggaaaacuaugcaaacuaaaaggaauagccccacuacaauuggggaaaugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagggaacaauugaguucaguaucaucauucgagagauucgaaauauuccccaaggaaaguucauggcccaaacacaacguaaccaaaggaguaacggcaucaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauagaggaccaaaagaccaucuaucguaaagaaaaugcuuauguaucuguagugucuucacauuauaacaggagauucaccccagaaauagcaaaaagacccaaaguaagaaaucaagaagggagaauuaauuacuacuggacucugcuggaacccggggacacaauaauauuugaggcaaauggaaaucuaauagcgccaugguaugcuuucgcauugaguagaggcuuugggucaggaaucaucaccucaaacgcaucgauggaugaaugugacgcgaagugucaaacaccccagggagcuauaaacaguagucuuccuuuucagaauguacacccagucacaauaggagagugcccaaaguacgucaggaguacaaaauuaaggaugguuacaggacuaaggaacaucccauccauucaauccagagguuuguuuggagccauugccgguuucauugaagggggauggacuggaaugauugauggaugguaugguuaucaucaucagaaugaacagggaucuggcuaugcugcggaucaaaaaagcacacaaaaugccauuaacgggauuacaaacaaggugaacucuauaaucgagaaaaugaauacucaauucacagcuguggguaaagaauucaacaaacuagaaaaaaggauggaaaacuuaaauaaaaaaguugaugauggauuucuggacauuuggacauauaaugcagaauuguugguucuacuggaaaaugaaaggacuuuggauuuccaugacucaaaugugaagaaccuguaugagaaaguaaaaagccaauuaaagaauaaugccaaagaaauaggaaacggguguuuugaauucuaccacaaguguaacaaugaaugcauggaaaguguaaaaaaugggacuuaugacuauccaaaauauucagaagaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32669 - RNA, 1701 nt, Artificial Sequence
  hemagglutinin__InfluenzaA__ABW91196
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32670 - RNA, 1701 nt, Artificial Sequence; identical to SEQ ID NO: 32669
  hemagglutinin__InfluenzaA__ABW91207

SEQ ID NO: 32671 - RNA, 1698 nt, Artificial Sequence
  hemagglutinin__InfluenzaA__ABW91218
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggaacugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggacgaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaacguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32672 - RNA, 1701 nt, Artificial Sequence
  hemagglutinin__InfluenzaA__ABW91240
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaauuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32673 - RNA, 1701 nt, Artificial Sequence
  hemagglutinin__InfluenzaA__ABW91251
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcauuuauuggacaauaguaaaaucgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagaaaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32674 - RNA, 1701 nt, Artificial Sequence; identical to SEQ ID NO: 32432
  hemagglutinin__InfluenzaA__ABW91262

SEQ ID NO: 32675 - RNA, 1698 nt, Artificial Sequence
  hemagglutinin__InfluenzaA__ABW91273
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaacaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32676 - RNA, 1698 nt, Artificial Sequence
  hemagglutinin__InfluenzaA__ABW91284
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuucccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaucaaugggugaaugugaugcgaagugccagacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaaugaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32677 - RNA, 1698 nt, Artificial Sequence; identical to SEQ ID NO: 32524
  hemagglutinin__InfluenzaA__ABW91295

SEQ ID NO: 32678 - RNA, 1698 nt, Artificial Sequence; identical to SEQ ID NO: 32437
  hemagglutinin__InfluenzaA__ABW91306

SEQ ID NO: 32679 - RNA, 1698 nt, Artificial Sequence; identical to SEQ ID NO: 32465
  hemagglutinin__InfluenzaA__ABW91317

SEQ ID NO: 32680 - RNA, 1698 nt, Artificial Sequence
  hemagglutinin__InfluenzaA__ABW91328
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggauaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaagaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32681 - RNA, 1698 nt, Artificial Sequence
  hemagglutinin__InfluenzaA__ABW91339
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugaaagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32682 - RNA, 1698 nt, Artificial Sequence
  hemagglutinin__InfluenzaA__ABW91350
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagaggcuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucugcuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32683 - RNA, 1698 nt, Artificial Sequence
  hemagglutinin__InfluenzaA__ABW91361
augaaaguaaaacuacuuguucuguuauguacauuuacagcuacauaugcagacacaauauguauaggcuaccaugccaacaacucgacugacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacggggaaagcaguuuuuacagaaauuuguuauggcugacggggaagaaugguuuguauccaaaccugagcaaguccuaugcaaacaacaaagagaaagaaguccuuguacugugggguguucaucacccgccuaacauaggagaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggauaaaugugaugcgaagugucaaacaccucagggagcuauaaacagcagucuuccuuuccagaauguacacccagucacaauaggagaguguccaaaguaugucaggaguacaaaauuaagaaugguuacaggacuaaggaacaucccauccauucaaaccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaauuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguuccuugguucuuuuggucucccugggggcaaucagcuucuggauguguuccaaugggucuuugcaguguagaauaugcaucuaa

SEQ ID NO: 32684 - RNA, 1698 nt, Artificial Sequence; identical to SEQ ID NO: 32494
  hemagglutinin__InfluenzaA__ABW91372

SEQ ID NO: 32685 - RNA, 1698 nt, Artificial Sequence; identical to SEQ ID NO: 32451
  hemagglutinin__InfluenzaA__ABW91383

SEQ ID NO: 32686 - RNA, 1701 nt, Artificial Sequence
  hemagglutinin__InfluenzaA__ABW91394
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcagguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32687 - RNA, 1698 nt, Artificial Sequence; identical to SEQ ID NO: 32585
  hemagglutinin__InfluenzaA__ABW91405

SEQ ID NO: 32688 - RNA, 1698 nt, Artificial Sequence
  hemagglutinin__InfluenzaA__ABW91416
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaaaggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaaggaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32689 - RNA, 1698 nt, Artificial Sequence
  hemagglutinin__InfluenzaA__ABW91427
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguaaugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguuaguucuacuggaaaaugaaaggacuuuggacuuccaugacuccaaugugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32690 - RNA, 1701 nt, Artificial Sequence; identical to SEQ ID NO: 32432
  hemagglutinin__InfluenzaA__ABW91438

SEQ ID NO: 32691 - RNA, 1698 nt, Artificial Sequence; identical to SEQ ID NO: 32577
  hemagglutinin__InfluenzaA__ABW91449

SEQ ID NO: 32692 - RNA, 1698 nt, Artificial Sequence
  hemagglutinin__InfluenzaA__ABW91460
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagaaaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32693 - RNA, 1698 nt, Artificial Sequence
  hemagglutinin__InfluenzaA__ABW91471
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaguagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32694 - RNA, 1698 nt, Artificial Sequence
  hemagglutinin__InfluenzaA__ABW91482
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggagaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32695 - RNA, 1698 nt, Artificial Sequence
  hemagglutinin__InfluenzaA__ABW91493
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaaaaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32696 - RNA, 1698 nt, Artificial Sequence
  hemagglutinin__InfluenzaA__ABW91504
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggggaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32697 - RNA, 1698 nt, Artificial Sequence
  hemagglutinin__InfluenzaA__ABW91515
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacguuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcaaauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggauuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32698 - RNA, 1698 nt, Artificial Sequence
  hemagglutinin__InfluenzaA__ABW91526
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuauccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagagcaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaagauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32699 - RNA, 1698 nt, Artificial Sequence
  hemagglutinin__InfluenzaA__ABW91537
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaaaaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32700 - RNA, 1701 nt, Artificial Sequence; identical to SEQ ID NO: 32584
  hemagglutinin__InfluenzaA__ABW91548

SEQ ID NO: 32701 - RNA, 1698 nt, Artificial Sequence
  hemagglutinin__InfluenzaA__ABW91559
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuugugcugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuguacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32702 - RNA, 1698 nt, Artificial Sequence
  hemagglutinin__InfluenzaA__ABW91570
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggagaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuauguuucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuauucaacagucgccaguucccugguucuuuuggucucccugggggcaaucagcuucuggauguguuccaaugggucuuugcaguguagaauaugcaucuaa

SEQ ID NO: 32703 - RNA, 1698 nt, Artificial Sequence; identical to SEQ ID NO: 32571
  hemagglutinin__InfluenzaA__ABW91581

SEQ ID NO: 32704 - RNA, 1698 nt, Artificial Sequence; identical to SEQ ID NO: 32424
  hemagglutinin__InfluenzaA__ABW91592

SEQ ID NO: 32705 - RNA, 1698 nt, Artificial Sequence
  hemagglutinin__InfluenzaA__ABW91603
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaaugcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcagugcagaauaugcaucuaa

SEQ ID NO: 32706 - RNA, 1698 nt, Artificial Sequence
  hemagglutinin__InfluenzaA__ABW91614
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaguccugagaauggaacauguuacccaggauauuucgccgacuaugaggagcugagggagcaauugaguucaguaucuucauuugagagguucgaaauauuccccaaagagagcucauggcccaaccacacaguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcaggagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucagcucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgauuuacucaacagucgccaguucccugguucuuuuggucucccugggggcaaucagcuucuggauguguuccaaugggucuuugcaguguagaauaugcaucuaa

SEQ ID NO: 32707 - RNA, 1698 nt, Artificial Sequence
  hemagglutinin__InfluenzaA__ABW91625
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacaggacuaaggaauaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32708 - RNA, 1698 nt, Artificial Sequence; identical to SEQ ID NO: 32681
  hemagglutinin__InfluenzaA__ABW91636

SEQ ID NO: 32709 - RNA, 1701 nt, Artificial Sequence; identical to SEQ ID NO: 32491
  hemagglutinin__InfluenzaA__ABW91647

SEQ ID NO: 32710 - RNA, 1707 nt, Artificial Sequence
  hemagglutinin__InfluenzaA__ABX10515
auggagaaaauagugcuucuuuuugcaauagucagucuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucuaauuuugagagauuguaguguagcuggauggcuccucggaaacccaaugugugacgaauucaucaaugugccggaauggucuuacauaguggagaaggccaauccagucaaugaccucuguuacccaggggauuucaaugacuaugaagaauugaaacaccuauugagcagaauaaaccauuuugagaaaauucagaucauccccaaaaguucuugguccagucaugaagucucauuaggggugagcucagcauguccauaccagggaaaguccuccuuuuucagaaaugugguauggcuuaucaaaaagaacaguacauacccaacaauaaagaggagcuacaauaauaccaaccaagaagaucuuuugguacugugggggauucaccauccuaaugaugcggcagagcagacaaagcucuaucaaaacccaaccaccuauauuuccguugggacaucaacacuaaaccagagauugguaccaagaauagcuacuagauccaaaguaaacgggcaaaguggaaggauggaguucuucuggacaauuuuaaaaccgaaugaugcaaucaacuucgagaguaauggaaauuucauugcuccagaauaugcauacaaaauugucaagaaaggggacucaacaauuaugaaaagugaauuggaauaugguaacugcaacaccaagugucaaacuccaaugggggcgauaaacucuaguaugccauuccacaauauacacccucucaccaucggggaaugccccaaauaugugaaaucaaacagauuaguccuugcgacugggcucagaaauagcccucaaagagagagaagaagaaaaaagagaggauuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaagauggaagacggguuccuagaugucuggacuuauaaugcugaacuucugguucucauggaaaaugagagaacucuagacuuucacgacucaaaugucaagaaccuuuacgacaagguccgacuacagcuuaaggauaaugcaaaggagcuggguaacgguuguuucgaguucuaucauaaaugugauaaugaauguauggaaaguguaagaaacggaacguaugacuacccgcaguauucagaagaagcaagacuaaaaagagaggaaauaaguggaguaaaauuggaaucaauaggaauuuaccaaauacugucaauuuauucuacaguggcgaguucccuagcacuggcaaucaugguagcuggucuauccuuauggaugugcuccaaugggucguuacaaugcagaauuugcauuuaa

SEQ ID NO: 32711 - RNA, 1701 nt, Artificial Sequence
  hemagglutinin__InfluenzaA__ABX10525
augaagacuaucauugcuuugagcuacauucuaugucugguuuucgcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggaucuagacccaggguaagggaugucuccagcagaauaagcaucuauuggacaauaguaaaaccgggagacauacuuuugauuaacagcacaggaaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaguuccaucagauugaaaaagaauucucagaaguagaagggagaauucaggaccucgagaaauauguugaggacacuaaaauagaucucuggucauacaacgcggagcuucuuguugcccuggaaaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32712 - RNA, 1698 nt, Artificial Sequence; identical to SEQ ID NO: 32442
  hemagglutinin__InfluenzaA__ABX58239

SEQ ID NO: 32713 - RNA, 1698 nt, Artificial Sequence
  hemagglutinin__InfluenzaA__ABX58250
augaaaguaaaacuacugguucuguuauguacauuuacagcuacauaugcagacacaauauguauaggcuaccaugccaacaauucaaccgacacuguugacacagugcuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagaacucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuugggaucaggaaucaucaccucaaaugcaccaauggaugaaugugaugcgaaaugucaaacaccucagggagcuauaaacagcagucuuccuuuccagaauguacacccagucacaauaggagagugucccaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggaccuauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32714 - RNA, 1698 nt, Artificial Sequence
  hemagglutinin__InfluenzaA__ABX58261
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaacgguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggucucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggggucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32715 - RNA, 1698 nt, Artificial Sequence
  hemagglutinin__InfluenzaA__ABX58272
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaaaagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32716 - RNA, 1698 nt, Artificial Sequence; identical to SEQ ID NO: 32429
  hemagglutinin__InfluenzaA__ABX58283

SEQ ID NO: 32717 - RNA, 1698 nt, Artificial Sequence
  hemagglutinin__InfluenzaA__ABX58294
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggagaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuauguuucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32718 - RNA, 1698 nt, Artificial Sequence; identical to SEQ ID NO: 32424
  hemagglutinin__InfluenzaA__ABX58316

SEQ ID NO: 32719 - RNA, 1698 nt, Artificial Sequence
  hemagglutinin__InfluenzaA__ABX58327
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguaaugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguuaguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagagagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32720 - RNA, 1698 nt, Artificial Sequence; identical to SEQ ID NO: 32489
  hemagglutinin__InfluenzaA__ABX58338

SEQ ID NO: 32721 - RNA, 1698 nt, Artificial Sequence
  hemagglutinin__InfluenzaA__ABX58360
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccaauacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgauggaugcauggagagugugaaaaauggaacuuaugacuauccaaaauauuccgaagaaucaaaguugaacagggagaaaauugauggagugaaauuggaaucaaugggggucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32722 - RNA, 1698 nt, Artificial Sequence; identical to SEQ ID NO: 32681
  hemagglutinin__InfluenzaA__ABX58371

SEQ ID NO: 32723 - RNA, 1698 nt, Artificial Sequence
  hemagglutinin__InfluenzaA__ABX58382
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagaccuaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32724 - RNA, 1698 nt, Artificial Sequence
  hemagglutinin__InfluenzaA__ABX58393
augaaaguaaaacuacugguucuguuauguacauuuacagcuacauaugcagacacaauauguauaggcuaccaugccaacaacucgaccgacacuguugacacaguacuugagaagaaugugacagugacacacucugucaaucuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagauucgaaauauuccccaaagagagcucauggcccaaccacaccguaaccggaguaucagcaucaugcucccauaacgggagaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuauguuucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32725 - RNA, 1698 nt, Artificial Sequence
  hemagglutinin__InfluenzaA__ABX58404
augaaaguaaaacuacuaguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuuugccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuaugguugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaacucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32726 - RNA, 1698 nt, Artificial Sequence
  hemagglutinin__InfluenzaA__ABX58415
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaagaaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcaaucuacucaacagucgccaguucccugguucuuuuggucucccugggggcaaucagcuucuggauguguuccaaugggucuuugcaguguagaauaugcaucuaa

SEQ ID NO: 32727 - RNA, 1698 nt, Artificial Sequence; identical to SEQ ID NO: 32429
  hemagglutinin__InfluenzaA__ABX58426

SEQ ID NO: 32728 - RNA, 1698 nt, Artificial Sequence; identical to SEQ ID NO: 32429
  hemagglutinin__InfluenzaA__ABX58437

SEQ ID NO: 32729 - RNA, 1698 nt, Artificial Sequence
  hemagglutinin__InfluenzaA__ABX58448
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggauuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32730 - RNA, 1698 nt, Artificial Sequence; identical to SEQ ID NO: 32577
  hemagglutinin__InfluenzaA__ABX58459

SEQ ID NO: 32731 - RNA, 1698 nt, Artificial Sequence; identical to SEQ ID NO: 32559
  hemagglutinin__InfluenzaA__ABX58470

SEQ ID NO: 32732 - RNA, 1698 nt, Artificial Sequence; identical to SEQ ID NO: 32577
  hemagglutinin__InfluenzaA__ABX58481

SEQ ID NO: 32733 - RNA, 1698 nt, Artificial Sequence
  hemagglutinin__InfluenzaA__ABX58492
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgcugacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32734 - RNA, 1698 nt, Artificial Sequence; identical to SEQ ID NO: 32571
  hemagglutinin__InfluenzaA__ABX58503

SEQ ID NO: 32735 - RNA, 1698 nt, Artificial Sequence; identical to SEQ ID NO: 32577
  hemagglutinin__InfluenzaA__ABX58525

SEQ ID NO: 32736 - RNA, 1698 nt, Artificial Sequence
  hemagglutinin__InfluenzaA__ABX58536
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaccgugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccuuagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaauggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32737 - RNA, 1698 nt, Artificial Sequence
  hemagglutinin__InfluenzaA__ABX58547
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaaaccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32738 - RNA, 1698 nt, Artificial Sequence
  hemagglutinin__InfluenzaA__ABX58558
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggagaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuauguuucuguagugucuucacauuauagcagaagauucaccccagaaauugccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggauaaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32739 - RNA, 1698 nt, Artificial Sequence
  hemagglutinin__InfluenzaA__ABX58569
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagggagcaauugaguucaguaucuucauuugagagguucgaaauauuccccaaagagagcucauggcccaaccacaccgcaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32740 - RNA, 1698 nt, Artificial Sequence; identical to SEQ ID NO: 32489
  hemagglutinin__InfluenzaA__ABX58580

SEQ ID NO: 32741 - RNA, 1698 nt, Artificial Sequence; identical to SEQ ID NO: 32429
  hemagglutinin__InfluenzaA__ABX58591

SEQ ID NO: 32742 - RNA, 1698 nt, Artificial Sequence
  hemagglutinin__InfluenzaA__ABX58602
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuagaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccagggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32743 - RNA, 1698 nt, Artificial Sequence; identical to SEQ ID NO: 32451
  hemagglutinin__InfluenzaA__ABX58613

SEQ ID NO: 32744 - RNA, 1698 nt, Artificial Sequence; identical to SEQ ID NO: 32681
  hemagglutinin__InfluenzaA__ABX58624

SEQ ID NO: 32745 - RNA, 1698 nt, Artificial Sequence
  hemagglutinin__InfluenzaA__ABX58635
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggagaagcaguuuuuacagaaauuugcuauggcugacggggaagaaugguuuguauccaagccugagcaaguccuaugcaaacaacaaagagaaagaaguccuuguacugugggguguucaucacccgccuaacauaggggaccaaagggcccucuaucauacagaaaaugcuuauguuucuguaguuucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32746 - RNA, 1698 nt, Artificial Sequence; identical to SEQ ID NO: 32430
  hemagglutinin__InfluenzaA__ABX58679

SEQ ID NO: 32747 - RNA, 1698 nt, Artificial Sequence; identical to SEQ ID NO: 32585
  hemagglutinin__InfluenzaA__ABX58701

SEQ ID NO: 32748 - RNA, 1698 nt, Artificial Sequence; identical to SEQ ID NO: 32713
  hemagglutinin__InfluenzaA__ABX58712

SEQ ID NO: 32749 - RNA, 1704 nt, Artificial Sequence
  hemagglutinin__InfluenzaA__ABY19417
auggagaaaauagugcuucuucuugcaauaaucagccuuguuaaaagugaucagauuugcauugguuaccaugcaaacaacucgacagagcagguugacacaauaauggaaaagaacguuacuguuacacaugcucaagauauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccaggaaauuucaacgacuaugaagaacugaaacaccuauugagcaggauaaaccauuuugagaaaauucagaucauccccaaaaguucuugguccgaucaugaagccucaucaggggugagcucagcauguccauaccagggagugcccuccuuuuucagaaaugugguauggcuuaucaaaaagaacaauacauacccaacaauaaagagaagcuacaauaauaccaaccaggaagaucuuuugauacugugggggauucaucauucuaaugaugcagcagagcagacaaagcucuaucaaaacccaaccaccuauauuuccguugggacaucaacacugaaccagagauugguaccaaaaauagcuacuagauccaaaguaaacgggcaaagcggaaggauggauuucuucuggacaauuuuaaaaccgaaugaugcaaucaacuucgagaguaauggaaauuucauugcuccagaauaugcauacaaaauugucaagaaaggggacucggcaauuaugaaaagugagguggaguaugguaacugcaacaccaagugucaaacuccaauaggggcgauaaacucuaguaugccauuccacaacauacacccucucaccaucggggaaugccccaaauaugugaaaucaaacaaauuaguccuugcgacuggacucagaaauaguccucuaagagaaagaagaagaaaaagaggacuauuuggagcuauagcagguuuuauagagggcggauggcagggaaugguagaugguugguauggguaucaccauagcaaugagcaggggaguggguacgcugcagacaaagaauccacucaaaaggcaauagauggagucaccaauaaggucaacucaaucauugacaaaaugaacacucaguuugaggccguuggaagggaauuuaauaacuuagagaggagaauagagaauuuaaacaagaaaauggaagacggauuccuagaugucuggacuuauaaugcugaacuucugguucucauggaaaaugagagaacucuagacuuccaugauucaaaugucaagaaccuuuacgacaagguccgacuacagcuuagggauaaugcaaaggagcuggguaacgguuguuucaaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauucgcauuuaa

SEQ ID NO: 32750 - RNA, 1704 nt, Artificial Sequence
  hemagglutinin__InfluenzaA__ABY19418
auggagaaaauagugcuucuucuugcaauaaucagccuuguuaaaagugaucagauuugcauugguuaccaugcaaacaacucgacagagcagguugacacaauaauggaaaagaacguuacuguuacacaugcucaagauauacuggaaaagacacacaacgggaagcucugcgaucuagauggagugaagccucugauuuuaagagauuguaguguagcuggauggcuccucggaaacccaaugugugaugaauucaucaaugugccggaauggucuuacauaguggagaaggccaacccagccaaugaccucuguuacccaggggauuucaacgacuaugaagaacugaaacaccuauugagcaggauaaaccauuuugagaaaauucagaucauccccaaaaguucuugguccgaucaugaagccucaucaggggugagcucagcauguccauaccagggagugcccuccuuuuucagaaaugugguauggcuuaucaaaaagaacaauacauacccaacaauaaagagaagcuacaauaauaccaaccaggaagaucuuuugauacugugggggauucaucauucuaaugaugcagcagagcagacaaagcucuaucaaaacccaaccaccuauauuuccguugggacaucaacacugaaccagagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucggcaauuaugaaaagugagguggaguaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcagguuuuauagagggcggauggcagggaaugguagaugguugguauggguuucaccauagcaaugagcaggggaguggguacgcugcagacaaagaauccacucaaaaggcaauagauggagucaccaauaaggucaacucaaucauugacaaaaugaacacucaguuugaggccguuggaagggaauuuaauaacuuagagaggagaauagagaauuuaaacaagaaaauggaagacggguuccuagaugucuggacuuauaaugcugaacuucugguucucauggaaaaugagagaacucuagacuuccaugauucaaaugucaagaaccuuuacgacaagguccgacuacagcuuagggauaaugcaaaggagcuggguaacgguuguuucgaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 32751 - RNA, 1704 nt, Artificial Sequence
  hemagglutinin__InfluenzaA__ABY19419
auggagaaaauagugcuucuucuugcaauaaucagccuuguuaaaagugaucagauuugcauugguuaccaugcaaacaacucgacagagcagguugacacaauaauggaaaagaacguuacuguuacacaugcucaagauauacuggaaaagacacacaacgggaagcucugcgaucuagauggagugaagccucugauuuuaagagauuguaguguagcuggauggcuccucggaaacccaaugugugaugaauucaucaaugugccggaauggucuuacauaguggagaaggccaacccagccaaugaccucuguuacccaggaaauuucaacgacuaugaagaacugaaacaccuauugagcaggauaaaccauuuugagaaaauucagaucauccccaaaaguucuugguccgaucaugaagccucaucaggggugagcucagcauguccauaccagggagugcccuccuuuuucagaaaugugguauggcuuaucaaaaagaacaauacauacccaacaauaaagagaagcuacaauaauaccaaccaggaagaucuuuugauacugugggggauucaucauucuaaugaugcagcagagcagacaaagcucuaucaaaacccaaccaccuauauuuccguugggacaucaacacugaaccagagauugguaccaaaaauagcuacuagauccaaaguaaacgggcaaagcggaaggauggauuucuucuggacaauuuuaaaaccgaaugaugcaaucaacuucgagaguaauggaaauuucauugcuccagaauaugcauacaaaauugucaagaaaggggacucggcaauuaugaaaagugagguggaguaugguaacugcaacaccaagugucaaacuccaauaggggcgauaaacucuaguaugccauuccacaacauacacccucucaccaucggggaaugccccaaauaugugaaaucaaacaaauuaguccuugcgacuggacucagaaauaguccucuaagagaaagaagaagaaaaagaggacuauuuggagcuauagcagguuuuauagagggcggauggcagggaaugguagaugguugguauggguaucaccauagcaaugagcaggggaguggguacgcugcagacaaagaauccacucaaaaggcaauagauggagucaccaauaaggucaacucaaucauugacaaaaugaacacucaguuugaggccguuggaagggaauuuaauaacuuagagaggagaauagagaauuuaaacaagaaaauggaagacggauuccuagaugucuggacuuauaaugcugaacuucugguucucauggaaaaugagagaacucuagacuuccaugauucaaaugucaagaaccuuuacgacaagguccgacuacagcuuagggauaaugcaaaggagcuggguaacgguuguuucgaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 32752 - RNA, 1698 nt, Artificial Sequence; identical to SEQ ID NO: 32702
  hemagglutinin__InfluenzaA__ABY51017

SEQ ID NO: 32753 - RNA, 1701 nt, Artificial Sequence; identical to SEQ ID NO: 32445
  hemagglutinin__InfluenzaA__ABY51028

SEQ ID NO: 32754 - RNA, 1698 nt, Artificial Sequence
  hemagglutinin__InfluenzaA__ABY51039
augaaaguaaaacuacugguccuguuaugcacauuuacagcuacaaaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaacaccaaauccugagaauggaacauguuacccagggcauuucgcugacuaugaggaacugagggagcaauugaguucaguaucuucauuugagagguucgaaauauuccccaaagaaagcucauggcccaaucacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagccuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaagguaaaaggccaguuaaagaauaaugccaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32755 - RNA, 1698 nt, Artificial Sequence
  hemagglutinin__InfluenzaA__ABY51050
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugauucgaaaugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugccaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32756 - RNA, 1698 nt, Artificial Sequence
  hemagglutinin__InfluenzaA__ABY51061
augaaaguaaaacuacugguucuguuauguacauuuacagcuacauaugcagacacaauauguauaggcuaccaugccaacaauucaaccgacacuguugacacagugcuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagaacucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuugggaucaggaaucaucaccucaaaugcaccaauggaugaaugugaugcgaaaugucaaacaccucagggagcuauaaacagcagucuuccuuuccagaauguacacccagucacaauaggagagugucccaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucagaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggaccuauaaugcggaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32757 - RNA, 1698 nt, Artificial Sequence
  hemagglutinin__InfluenzaA__ABY51072
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccggucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagcauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggggucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32758 - RNA, 1698 nt, Artificial Sequence
  hemagglutinin__InfluenzaA__ABY51083
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucauggucuuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauuuaacaaauuggaaaggagaauggaaaacuuaaauaaaaaaguugaugauggguuucuagacauuuggacguauaacgcagaguuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32759 - RNA, 1698 nt, Artificial Sequence; identical to SEQ ID NO: 32699
  hemagglutinin__InfluenzaA__ABY51094

SEQ ID NO: 32760 - RNA, 1698 nt, Artificial Sequence
  hemagglutinin__InfluenzaA__ABY51105
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggagaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuauguuucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguaggauaugcaucuaa

SEQ ID NO: 32761 - RNA, 1698 nt, Artificial Sequence
  hemagglutinin__InfluenzaA__ABY51116
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugagugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32762 - RNA, 1701 nt, Artificial Sequence
  hemagglutinin__InfluenzaA__ABY51127
augaagacuaucauugcuuugagcuacauucuauguaugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggaaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32763 - RNA, 1698 nt, Artificial Sequence
  hemagglutinin__InfluenzaA__ABY51138
augaaagugaaacuacugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagaaaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaagguucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaauccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32764 - RNA, 1698 nt, Artificial Sequence; identical to SEQ ID NO: 32465
  hemagglutinin__InfluenzaA__ABY51149

SEQ ID NO: 32765 - RNA, 1698 nt, Artificial Sequence
  hemagglutinin__InfluenzaA__ABY51160
augaaagugaaacuacuaguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucugcuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcaaauccuaugcaaacaauaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucuacuggaacccggggauacaauaauauuugaggcaaauggaaaucuaauagcgccaagguuugcuuucgcacugaguagaggcuuuggaucaggaaucaucaccucaaaugcaccaauggauaaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugauagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaaggauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32766 - RNA, 1698 nt, Artificial Sequence
  hemagglutinin__InfluenzaA__ABY51171
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucacacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacagggcuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuaucaaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuuacaguguagaauaugcaucuaa

SEQ ID NO: 32767 - RNA, 1698 nt, Artificial Sequence
  hemagglutinin__InfluenzaA__ABY51182
augaaaguaaaacuacugauucuguuauguacauuuacagcuacauaugcagacacaauauguauagguuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcaguguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuucagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32768 - RNA, 1698 nt, Artificial Sequence; identical to SEQ ID NO: 32571
  hemagglutinin__InfluenzaA__ABY51193

SEQ ID NO: 32769 - RNA, 1698 nt, Artificial Sequence; identical to SEQ ID NO: 32429
  hemagglutinin__InfluenzaA__ABY51237

SEQ ID NO: 32770 - RNA, 1698 nt, Artificial Sequence
  hemagglutinin__InfluenzaA__ABY51248
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggauauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuucuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacauccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32771 - RNA, 1698 nt, Artificial Sequence
  hemagglutinin__InfluenzaA__ABY51259
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccuccaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggggucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32772 - RNA, 1701 nt, Artificial Sequence
  hemagglutinin__InfluenzaA__ABY51270
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacugauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaagucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcgggcuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32773 - RNA, 1707 nt, Artificial Sequence
  hemagglutinin__InfluenzaA__ABY76282
auggagaaaauagugcuucuucuugcaauagucagucuuguuaaaagugaucagauuugcauugguuaccaugcaaacaacucgacagagcauguugacacaauaauggaaaagaacgucacuguuacacacgcccaagauauacuggaaaaggcacacaacgggaggcucugcgaucuagacggagugaagccucuaaucuuaagagauuguaguguagcuggauggcuccucgggaacccaaugugugacgaauuccucaaugugccggaauggucuuauauaguggagaagaacaauccagccaaugaccucuguuacccagggaauuucaacgacuaugaagaauugaaacaccuauugagcagaauaaaccauuuugagaaaauucagaucauccccaaaaguucuuggucggaucaugaagccucaucaggggugagcucagcauguccauaccagggaagguccuccuuuuuuagaaaugugguauggcuuaucaaaaagaacgaugcauauccaacaauaaagagaaguuacaauaauaccaaccaagaagaucuuuugguacugugggggauucaccauccaaaugaugcggcagagcagacaaggcucuaucaaaacccaaccaccuauauuuccguugggacaucaacacuaaaccagagauugguaccaaaaauagcuacuagauccaagguaaacgggcaaaguggaaggauggaguucuuuuggacaauuuuaaaaccgaaugaugcgauaaacuuugagaguaauggaaauuucauugcuccagaaaaugcauacaaaauugucaagaaaggggacucaacaaucaugaaaagugaauuggaauaugguaauugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaagaaaaaagagagggcuauuuggagcuauagcagguuuuauagagggaggauggcagggaaugguagaugguugguauggguaucaccauagcaacgagcaggggaguggguacgcugcagacaaagaauccacucaaaaggcaauagauggagucaccaauaaggucaacucgaucauugacaaaaugaacacucaguuugaggcaguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaagugugagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 32774 - RNA, 1701 nt, Artificial Sequence
  hemagglutinin__InfluenzaA__ABY81349
augaaagcaaaacuacugguccuguuaugugcacuuucagcuacagaugcagacacaauauguauaggcuaccaugcgaacaacucaaccgacacuguugacacaguacucgaaaagaacgugacagugacacacucugucaaccuacuugaggacagucacaacggaaaacuaugcagacuaaaaggaauagcuccacuacaauuggggaaaugcagcauugccggauggaucuuaggaaacccagaaugcgaaucacuguuuucuaagaaaucauggucuuacauugcagaaacaccaaacuccgagaauggaacauguuacccaggauauuucgccgacuaugaggaacugagggagcaauugaguucaguaucaucauucgagagauucgaaauauuccccaaggaaagaucauggcccaaacacaacguaaccagaggaguaacggcagcaugcucccauaaggggaaaagcaguuuuuacagaaauuugcuauggcugacggagaaaaauggcucguacccaaaucugagcaaguccuaugugaacaacaaagagaaagaaguccuuguacuaugggguguucaucacccgucuaacauaaaggaccaaaagaccaucuaucagaaagaaaaugcuuaugucucuguagugucuucaaauuauaacaggagauucaccccagaaauagcaaaaagacccaaaguaagagaucaagaagggagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucgauggaugaaugugacacgaagugucaaacaccccagggagcuauaaacaguagccuuccuuuccagaauguacacccagucacaauaggagagugcccaaaauacgucaggaguacaaaauuaaggaugguuacaggacuaagaaacaucccauccauucaauccagaggucuguuuggagccauugccgguuucauugaagggggauggacuggaaugauagauggaugguaugguuaucaucaucagaaugaacagggaucuggcuaugcugcggaucaaaaaagcacacaaaaugccauuaacgggauuacaaacaaggugaacucuguuaucgagaaaaugaacacucaauucacagcuguggguaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaguaggaaacggguguuuugaauucuaccacaaguguaacaaugaaugcauggaaaguguaaaaaauggaacuuaugacuauccaaaauauucagaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcagugcagaauaugcaucuga

SEQ ID NO: 32775 - RNA, 1701 nt, Artificial Sequence
  hemagglutinin__InfluenzaA__ABY81371
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaagaagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32776 - RNA, 1698 nt, Artificial Sequence; identical to SEQ ID NO: 32429
  hemagglutinin__InfluenzaA__ABY81382

SEQ ID NO: 32777 - RNA, 1698 nt, Artificial Sequence
  hemagglutinin__InfluenzaA__ABY81393
augaaagugaaacuauugguucuguuauguacauuuacagcuacauaugcagacacaauauguauaggcuaccaugccaacaacucgaccgacacuguugacacaguacuugagaagaaugugacagugacacacucugucaaccuacuugaggaccgucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacgggaaagaaugguuuguacccaaaccugagcagauccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaauuacuacuggacucuacuggaacccggggauacaauaauauuugaggcaaaugggaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaccagaaugagcaaggaucuggguaugcugcagaucaaaaaagcacacaaaaugccauuaacgggauuacaaacaaggugaauucugugauugagaaaaugaacacucaauucacagcugugggcaaagaauucaacaaauuggaaagaagaauggaaaacuuaaauaaaaaaguugaugauggguuucuagacauuuggacguauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32778 - RNA, 1698 nt, Artificial Sequence
  hemagglutinin__InfluenzaA__ABY81415
augaaaguaaaacuacuuguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaguccugagaauggaacauguuacccgggauauuucgccgacuaugaggagcugagagagcaauugaguucaguaucuucauuugagagguucgaaauauuccccaaagagagcucauggcccaaccacacaguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaaugggugaaugugaugcgaagugucaaacaccucagggagcuauaaacaguagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaacucuguaauugagaaaaugaacacucaauucacagcugugggcaaagaauucaacaaauuggaaagaaggauggaaaacuuaaauaaaaagguugaugauggauuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgauuuacucaacagucgccaguucccugguucuuuuggucucccugggggcaaucagcuucuggauguguuccaaugggucuuugcaguguagaauaugcauuuaa

SEQ ID NO: 32779 - RNA, 1701 nt, Artificial Sequence
  hemagglutinin__InfluenzaA__ACA24502
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacaguacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaauuagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32780 - RNA, 1698 nt, Artificial Sequence
  hemagglutinin__InfluenzaA__ACA24513
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaauucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccagggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32781 - RNA, 1698 nt, Artificial Sequence; identical to SEQ ID NO: 32429
  hemagglutinin__InfluenzaA__ACA24524

SEQ ID NO: 32782 - RNA, 1701 nt, Artificial Sequence
  hemagglutinin__InfluenzaA__ACA24689
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagaucauugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguccaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaaagacaaagaagcaacugagggaaaaugcugaggauaugggcaaugguuguuucaaaauauaccacaaaugugacaaugccugcauaggaucaaucagaaauggaacuuaugaccauuauguauacagagaugaagcauuaaacaaccgguuucagaucaagggcauugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32783 - RNA, 1701 nt, Artificial Sequence
  hemagglutinin__InfluenzaA__ACA24700
augaagacuaucauugcuuugagcuacauucuaugucugguuuucgcucaaaaacuucccggaauugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagccaagccuacagcaacuguuacccuuaugaugugccggauuaugccucccuuaggucacuaguugccucauccggcacacuggaguuuaacaaugaaagcuucaauuggacuggaguuacucaaaauggaacaagcucugcuugcaaaaggggaucuaauaacaguuucuuuaguagauugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagucaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaccagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuauuugaaaagacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuucagaucaagggcguugagcugaagucaggauacaaagauuggauccuauggauuuccuuugccauaucauguuuuuugcuuuguguugcauuguugggguucaucaugugggccugccaaaaaggcaacauuaggugcaacauuugcauuuga

SEQ ID NO: 32784 - RNA, 1698 nt, Artificial Sequence
  hemagglutinin__InfluenzaA__ACA28846
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguauccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuuacaguguagaauaugcaucuaa

SEQ ID NO: 32785 - RNA, 1701 nt, Artificial Sequence
  hemagglutinin__InfluenzaA__ACA33749
augaagacuaucauugcuuugagcuacauuuuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucuucuugcauaagaagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32786 - RNA, 1698 nt, Artificial Sequence; identical to SEQ ID NO: 32430
  hemagglutinin__InfluenzaA__ACA96519

SEQ ID NO: 32787 - RNA, 1659 nt, Artificial Sequence
  hemagglutinin__InfluenzaA__ACC55270
augaacacucaaauucuggcauucauugcuugugugcugacuggaguuaaaggagacaaaauaugucuugggcaccaugcuguggcaaauggaacaaaagugaacacauuaacagagagggggauugaaguagugaaugccacagagacaguggaaacuacgaauaucaagaaaauauguacccaggggaaaaggccaacagaucugggacaauguggacuucuaggaacccuaauaggaccuccccaaugugaucaauuccuggaguuuuccucugauuugauaauugagcgaagagaaggaaccgauauaugcuaucccgguagauucacaaacgaagaaucacugaggcagauccuucgaagaucaggaggaauugguaaggagucaaugggcuucaccuauaguggaauaagaaccaauggagcgacaagugccugcacaagaucagguucuucuuucuaugcagagaugaagugguugcugucgaauucagauaaugcagcauucccacagaugacaaaggcguauagaaaucccagaaacaaaccagcucugauaauuuggggaguucaucacucugaaucgguuagcgagcagaccaaacucuauggaaguggaaacaaguugauaacaguaagaagcucaaaauaccagcaaucauucaccccaaauccgggagcacgaagaaucgauuuccacuggcuacuccuugaucccaaugacacagugaccuucacuuucaauggagcauucauagccccugacaggacaaguuucuuuaggggagaaucacuaggaguccagagugaugcuccuuuggauucaaguuguagaggagauugcuuucacaguggggguacgauagucaguucccugccauuccaaaacaucaacucuagaacuguggggaaaugcccucgguaugucaaacagaaaagccuccuucuggcuacaggaaugagaaauguuccagagaaaccaaagcccagaggccuuuuuggagcaauugcuggauucauagagaauggaugggagggucucaucaauggaugguaugguuucagacaucaaaaugcacaaggagagggaacugcagcugacuacaaaagcacccagucugcaauagaucagaucacaggcaaauugaaucguuuaauuggcaaaacaaaucagcaguuugagcugauagacaaugaguucaaugagauagaacaacaaauaggaaaugucauuaauuggacaagagacgcaaugacugagauauggucguauaaugcugagcuguugguggcaauggaaaaucagcauacaauagaucuugcggacucagaaaugagcaaacuuuaugagcgugucaaaaaacaacuaagggagaaugcugaagaagauggaacuggauguuuugagauauuucauaaaugugacgaucaguguauggagagcauaaggaacaacacguaugaccauacucaauacagaacagagucauugcagaauagaauacagauagacccagugaaguugaguaguggguacaaagacauaaucuuaugguuuagcuucggggcaucauguuuucuucuucuagccauugcaaugggacugguuuucauuugcauaaagaauggaaacaugcagugcacuauuuguauauag

SEQ ID NO: 32788 - RNA, 1698 nt, Artificial Sequence; identical to SEQ ID NO: 32566
  hemagglutinin__InfluenzaA__ACC61964

SEQ ID NO: 32789 - RNA, 1698 nt, Artificial Sequence
  hemagglutinin__InfluenzaA__ACC61975
augaaaguaaaacuacugguucuguuauguacauuuacagcuucauaugcggacacaauauguauaggcuaccaugccaacaauucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguggaaguaccaaauccugagaauggaacauguuacccaggguauuucgccgacuaugaggagcugagggagcaauugaguucaauaucuucauuugagagguucgaaauauuccccaaagagagcucauggcccaaccacaccguaaccggaguaucggcaucaugcucccauaacgggaaaagcaguuuuuacagaaauuugcuauggcugacggggaaaaaugguuuguacccaaaccugagcaaguccuaugcaaacaacaaagagaaagaaguccuuguacuaugggguguccaucacccaccuaacauaggggaccaaagggcccucuaucauacggaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuugggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggaccuauaaugcagaauuguugguucuacuggaaaaugaaaggacuuuggauuuccaugacuccaacgugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32790 - RNA, 1698 nt, Artificial Sequence; identical to SEQ ID NO: 32430
  hemagglutinin__InfluenzaA__ACC61986

SEQ ID NO: 32791 - RNA, 1698 nt, Artificial Sequence
  hemagglutinin__InfluenzaA__ACD37430
augaaagcaaaacuacugguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagauucgaaauauuccccaaagaaagcucauggcccacccacaccguaaccggaguaucagcaucaugcucccauaaugggaaaagcaguuuuuacagaaauuugcuauggcugacggggaagaaugguuuguacccaaaccugagcaaguccuauguaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaaguaagagaucaggaaggaagaaucaacuacuacuggacucugcuggaaccuggggauacaauaauauuugaggcaaauggaaaucuaauagcgccaugguaugcuuuugcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaaguacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucccugguucuuuuggucucccugggggcaaucagcuucuggauguguuccaaugggucuuugcaguguagaauaugcaucuga

SEQ ID NO: 32792 - RNA, 1698 nt, Artificial Sequence
  hemagglutinin__InfluenzaA__ACD37507
augaaagcaaaacuacugguccuguuaugcacauuugcagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauugcugauuuccaaggagucaugguccuauauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauagguaaccaaaaggcccucuaucauacagaaaaugcuuaugucucuguagugucuucacauuauagcagaaaauucaccccagaaauagccaaaagacccaaaguaagagaucaagaaggaagaaucaauuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32793 - RNA, 1698 nt, Artificial Sequence; identical to SEQ ID NO: 32717
  hemagglutinin__InfluenzaA__ACD56113

SEQ ID NO: 32794 - RNA, 1698 nt, Artificial Sequence; identical to SEQ ID NO: 32494
  hemagglutinin__InfluenzaA__ACD56124

SEQ ID NO: 32795 - RNA, 1701 nt, Artificial Sequence; identical to SEQ ID NO: 32491
  hemagglutinin__InfluenzaA__ACD56258

SEQ ID NO: 32796 - RNA, 1701 nt, Artificial Sequence; identical to SEQ ID NO: 32496
  hemagglutinin__InfluenzaA__ACD56269

SEQ ID NO: 32797 - RNA, 1698 nt, Artificial Sequence
  hemagglutinin__InfluenzaA__ACD56280
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugggaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaagcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 32798 - RNA, 1689 nt, Artificial Sequence
  hemagglutinin__InfluenzaA__ACD56324
auggccaucauuuaucucauucuccuguucacagcagugagaggggaccagauaugcauuggauaccaugccaauaauuccacagagaaggucgacacaauucuagagcggaacgucacugugacucaugccaagaacauucuugagaagacccauaacggaagguuaugcaaacuaaacggaaucccuccacuugaacuaggggacuguagcauugccggauggcuccuuggaaauccagaaugugauaggcuucuacgugugccagaaugguccuauauaauggagaaagaaaacccgagaaacgguuuguguuauccaggcagcuucaaugauuaugaagaauugaaacaucuccucagcagcgugaaacauuucgagaaaguaaggauccugccaaaagauagauggacacagcauacaacaacuggaaguucacgggccugcgcggugucugguaauccaucauucuucaggaacauggucuggcugacaaagaaagaaucaaauuauccgguugccaaaggaucguacaacaauacaagcggagaacaaaugcuaauaauuuggggggugcaccaucccaucgaugaaacagaacaaagaacauuguaccagaaugugggaaccuauguuuccguaggcacaucaacauugaacaaaaggucaaccccagacauagcaacaaggccuaaagugaauggacuaggaaguagaauggaauucucuuggacccucuuggauaugugggacaccauaaauuuugagaguacugguaaucuaauugcaccagaauauggauucaaaauaucgaaaagagguaguucagggaucaugaaaacagaaagaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaccaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagaggagacuggagaacuugaacaaaaagauggaagacggguuccuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauucuugccauuuaugcuacaguagcagguucucugucacuggcaaucaugauggcugggaucucuuucuggaugugcuccaacgggucucugcagugcaggaucugcauauga

SEQ ID NO: 32799 - RNA, 1689 nt, Artificial Sequence
  hemagglutinin__InfluenzaA__ACD85187
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccgagauacaguuuguguuacccaggcagcuucaaugacuaugaagaauugaaacaucuccucagcagcguaaaacauuucgagaaaguaaagauucugcccaaagauagauggacacagcauacaacaacuggagguucaaaggccugcgcagugucagguaaaccaucauucuucaggaacauggucuggcugacaaagaaaggaccaaauuauccgguugccaaaggaucguacaacaauacgagcggagagcaaaugcuaauaauuuggggagugcaccauccuaaagaugaggcagaacaaagagcauuguaccaggaagugggaaccuauguuuccgcaagcacaucaacauugaacaaaaggucaaccccugaaauagcagcaaggccugaagugaauggacuaggaaguagaauggaauucucuuggacccucuuggaugugugggacaccauaaauuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaauaauuuagagaaaagacuggagaacuugaacaaaaagauggaagacggguuucuagauguguggacauacaaugcugagcuucuaguucugauggaaaaugagaggacacuugacuuucaugauucuaaugucaagaaccuguaugauaaagucagaaugcagcugagagacaacgucaaagaacuaggaaauggauguuuugaauuuuaucacaaaugugacgaugaaugcaugaauagugugaaaaacgggacguaugauuaucccaaguaugaagaagaaucuaaacuaaauagaaaugaaaucaaagggguaaaauugagcagcauggggguuuaccaaauucuugccauuuaugcuacaguugcagguucucugucacuggcaaucaugauggcugggaucucuuucuggaugugcuccaacgggucucugcagugcagaaucugcauauga

SEQ ID NO: 32800 - RNA, 1689 nt, Artificial Sequence
  hemagglutinin__InfluenzaA__ACD85198
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggauuguagcauugccggauggcuccuuggaaauccagaaugugauaggcuucuaagggugccagaaugguccuauauaauggagaaagaaaacccgagauacaguuuguguuacccaggcagcuucaaugacuaugaagaauugaaacaucuccucagcagcguaaaacauuucgagaaaguaaagauccugcccaaagauggauggacacagcauacaacaacuggagguucaaaggccugcgcagugucagguaaaccaucauucuucaggaacauggucuggcugacaaagaaaggaccaaauuauccgguugccaaaagaucguacaacaauacgagcggagagcaaaugcuaauaauuuggggagugcaccauccuacugaugaggcagaacaaagagcauuguaccaggaagugggaaccuauguuuccgcaagcacaucaacauugaacaaaaggucaaccccagaaauagcagcaaggccugaagugaauggacuaagaaguagaauggaauucucuuggacccucuuggaugugugggacaccauaaauuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugauagaaucaccaacaagguaaauucugugauugaaaagaugaacacccaauuugaagcuguugggaaagaauucaguaacuuagagaaaagacuggagaacuugaacaaaaagauggaagacggguuucuagauguguggacauacaaugcugagcuucuaguucugauggaaaaugagaggacacuuggcuuucaugauucuaaugucaagaaccuguaugauaaagucagaaugcagcugagagacaacgucaaagaacuaggaaauggauguuuugaauuuuaucacaaaugugacgaugaaugcaugaauagugugaaaaacgggacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugauggcugggaucucuuucuggaugugcuccaacgggucucugcagugcagaaucugcauauga

SEQ ID NO: 32801 - RNA, 1689 nt, Artificial Sequence
  hemagglutinin__InfluenzaA__ACD85209
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacacagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacaaggagguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32802 - RNA, 1689 nt, Artificial Sequence
  hemagglutinin__InfluenzaA__ACD85220
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccgaaauacaguuuguguuacccaggcagcuucaaugacuaugaagaauugaaacaucuccucagcagcguaaaacauuucgagaaaguaaagauucugcccaaagauagauggacacagcauacaacaacuggagguucaaaggccugcgcagugucaggugaaccaucauucuucaggaacauggucuggcugacaaagaaaggaccaaauuauccgguugccaaaggaucguacaacaauacgagcggagagcaaaugcuaauaauuuggggagugcaccauccuaaggaugaggcagaacaaagagcauuguaccagaacgugggaaccuauguuuccgcaagcacaucaacauugaacaaaaggucaaccccugaaauagcagcaaggccugaagugaauggacuaggaaguagaauggaauucucuuggacccucuuggaugugugggacaccauaaauuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccacccacuaacaauaggugaaugccccaaauauguaaaaucggagaaauuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaauaauuuagagaaaagacuggagaacuugaacaaaaagauggaagacggguuucuagauguguggacauacaaugcugagcuucuaguucugauggaaaaugagaggacacuugacuuucaugauucuaaugucaagaaccuguaugauaaagucagaaugcagcugagagacaacgucaaagaacuaggaaauggauguuuugaauuuuaucacaaaugugacgaugaaugcaugaauagugugaaaaacgggacguaugauuaucccaaguaugaaaaagaaucuaaacuaaauagaaaugaaaucaaagggguaaaauugagcagcauggggguuuaccaaauucuugccauuuaugcuacaguugcagguucucugucacuggcaaucaugauggcugggaucucuuucuggaugugcuccaacgggucucugcagugcagaaucugcauauga

SEQ ID NO: 32803 - RNA, 1689 nt, Artificial Sequence
  hemagglutinin__InfluenzaA__ACD85242
auggccaucauuuaucucauacuccuguucgcaacagugaggggggaccagauaugcauuggauaccaugccaauaauuccacagaaaaggucgacacaauucuagagcggaaugucacugugacucaugccaaggacauccuugagaagacccacaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccaagauacaguuuguguuacccaggcagcuuaaaugacuaugaagaauugaaacaucuccucagcagcguaaaacauuucgagaaaguaaggauucugcccaaagauagauggacacagcauacaacaacuggagguucaaaggccugcgcagugucagguaaaccaucauucuucaggaacauggucuggcugacaaagaaaggaccaaauuauccgguugccaaaggaucguacaacaauacgagcggagagcaaaugcuaauaauuuggggagugcaccaucccaaagaugaggcagaacaaagagcauuguaccaggaagugggaaccuauguuuccgcaagcacaucaacauugaacaaaaggucaaucccugaaauagcagcaaggccugaagugaauggacuuggaaguagaauggaauucucuuggacacucuuggauguaugggacaccauaaauuuugagagcacugguaaucuaguugcaccagaguauggauucaaaauaucgaaaagagguaguucaggaaucaugaagacagaaggaacacuugggaacugugagaccaaaugucaaacuccuuugggggcgauaaauacaacacuaccuuuucacaauguccauccacugacaauaggugaaugccccaaauauguaaaaucggagaaauuggucuuagcaacagggcuaaggaauguuccccaaauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugauggaaucaccaacaaggugaauucuaugauugaaaagaugaacacccaauuugaagcuguugggaaagaauucaauaauuuagagaaaagacuggagaacuuggacaaaaagauggaagacggguuccuagauguguggacauacaaugcugagcuucuaguucugauggaaaaugagaggacacuugacuuccaugauucuaaugugaaaaaccuguaugaaaaagucagaaugcagcugagagacaacgucaaagaacuaggaaauggauguuuugaauuuuaucacaaaugugacaaugaaugcaugaauagugugaaaaacggaacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugguggcugggaucucuuucuggaugugcuccaacgggucucugcagugcagaaucugcauauga

SEQ ID NO: 32804 - RNA, 1689 nt, Artificial Sequence
  hemagglutinin__InfluenzaA__ACD85253
auggccaucauuuaucucauacuccuguucgcaacagugaggggggaccagauaugcauuggauaccaugccaauaauuccacagaaaaggucgacacaauucuagagcggaaugucacugugacucaugccaaggacauccuugagaagacccacaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccaagauacaauuuguguuacccaggcagcuuaaaugaauaugaagaauugaaacaucuccucagcagcguaaaacauuucgagaaaguaaggauucugcccaaagauagauggacacagcauacaacaacuggagguucaaaggccugcgcagugucaggugaaccaucauucuucaggaacauggucuggcugacaaagaaaggaccaaauuauccgguugccaaaggaucguacaacaauacgagcggagagcaaaugcuaauaauuuggggagugcaccauccuaaugaugaggcagagcaaagagcauuguaccagaaagugggaaccuauguuuccgcaagcacaucaacauugaacaaaaggucaaucccugaaauagcagcaaggccuaaagugaauggacuuggaaguagaauggaauucuuuuggacccucuuggauguaugggacaccauaaauuuugagagcacugguaaucuaguuguaccagaguauggauucaaaauaucaaaaagagguaguucagggaucaugaagacagaaggaacacuuggaaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccaaauugaaucaagaggacuguuuggggcaauagcuggcuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaaacuguugggaaagaauucaauaauuuagagaaaagacuggagaacuugaacaaaaagauggaagacggguuccuagauguguggacauacaaugcugagcuucuaguucugauggaaaaugagaggacacuugacuuccaugauucuaauguaaaaaaccuguaugaaaaagucagaaugcagcugagagacaacgucaaagaacuaggaaauggauguuuugaauuuuaucacaaaugugacgaugaaugcaugaauagugugaaaaacggaacguaugauuaucccaaguaugaagaagaaucuaaacuaaagagaaaugaaaucaaagggguaaaauugagcagcaugggaguuuaccaaauucuugccauuuaugcuacaguugcagguucccugucacuggcaaucaugguggcugggaucucuuucuggaugugcuccaacgggucucugcagugcagaaucugcauauga

SEQ ID NO: 32805 - RNA, 1701 nt, Artificial Sequence
  hemagglutinin__InfluenzaA__ACD85440
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacucacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggaucugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32806 - RNA, 1701 nt, Artificial Sequence
  hemagglutinin__InfluenzaA__ACD85451
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggaucugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32807 - RNA, 1701 nt, Artificial Sequence; identical to SEQ ID NO: 32806
  hemagglutinin__InfluenzaA__ACD85462

SEQ ID NO: 32808 - RNA, 1701 nt, Artificial Sequence
  hemagglutinin__InfluenzaA__ACD85473
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguauauuugggggguucaccacccgggcacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32809 - RNA, 1701 nt, Artificial Sequence
  hemagglutinin__InfluenzaA__ACD85484
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuagaucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaagaauuugacaaauuguauauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32810 - RNA, 1701 nt, Artificial Sequence
  hemagglutinin__InfluenzaA__ACD85495
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguauauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuagagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32811 - RNA, 1701 nt, Artificial Sequence
  hemagglutinin__InfluenzaA__ACD85528
augaagacuaucauugcuuuaagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaacggaacaagcucugcuugcauaaggagaucuaauaaaaguuucuuuaguagauugaauugguugacccacuuaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggaucugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32812 - RNA, 1701 nt, Artificial Sequence
  hemagglutinin__InfluenzaA__ACD85539
augaagacuaucauugcuuugagcuacauucuaugucugguuuucgcucaaaaacuuccuggaaaugacaacagcacggcaacguugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaacuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32813 - RNA, 1701 nt, Artificial Sequence
  hemagglutinin__InfluenzaA__ACD85550
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggaucugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccaugucauguuuuuugcuuuguguugcuuuguugggguucaucaugugggccugccaaaaaggcaacauuaggugcaacauuugcauuuga

SEQ ID NO: 32814 - RNA, 1701 nt, Artificial Sequence; identical to SEQ ID NO: 32808
  hemagglutinin__InfluenzaA__ACD85561

SEQ ID NO: 32815 - RNA, 1701 nt, Artificial Sequence
  hemagglutinin__InfluenzaA__ACD85572
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguauauuugggggguucaccacccgggcacggacaaugaccaaaucuuccuguaugcucaagcaucaggaagaaucacagucucuaccaaaagaagccaacaaacuguaaucccgaauaccggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32816 - RNA, 1701 nt, Artificial Sequence; identical to SEQ ID NO: 32812
  hemagglutinin__InfluenzaA__ACD85583

SEQ ID NO: 32817 - RNA, 1701 nt, Artificial Sequence
  hemagglutinin__InfluenzaA__ACD93579
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugcaucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaauaccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32818 - RNA, 1701 nt, Artificial Sequence; identical to SEQ ID NO: 31139
  hemagglutinin__InfluenzaA__ACF09402

SEQ ID NO: 32819 - RNA, 1701 nt, Artificial Sequence
  hemagglutinin__InfluenzaA__ACF22159
augaagacuaucauugcuuugagcuacauucuaugucugguuuuugcucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaauuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccggguacggacagugaccaaaucagccuauaugcucaagcaucaggaagaaucacagucucuaccaaaagaagccaacaaacuguaaucccgaauaucggauuuagacccaggguaagggaugucuccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32820 - RNA, 1701 nt, Artificial Sequence
  hemagglutinin__InfluenzaA__ACF22188
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucugguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggaauuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32821 - RNA, 1701 nt, Artificial Sequence
  hemagglutinin__InfluenzaA__ACF22199
augaagaccaucauugcuuugagcuacauuuucugucuggcucucggccaagaccuuccaggaaaugacaacaguacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucugguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggaauuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32822 - RNA, 1701 nt, Artificial Sequence
  hemagglutinin__InfluenzaA__ACF22210
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32823 - RNA, 1701 nt, Artificial Sequence
  hemagglutinin__InfluenzaA__ACF22221
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32824 - RNA, 1701 nt, Artificial Sequence; identical to SEQ ID NO: 32822
  hemagglutinin__InfluenzaA__ACF22232

SEQ ID NO: 32825 - RNA, 1701 nt, Artificial Sequence; identical to SEQ ID NO: 32823
  hemagglutinin__InfluenzaA__ACF22243

SEQ ID NO: 32826 - RNA, 1701 nt, Artificial Sequence; identical to SEQ ID NO: 32823
  hemagglutinin__InfluenzaA__ACF22254

SEQ ID NO: 32827 - RNA, 1701 nt, Artificial Sequence; identical to SEQ ID NO: 32823
  hemagglutinin__InfluenzaA__ACF22265

SEQ ID NO: 32828 - RNA, 1701 nt, Artificial Sequence; identical to SEQ ID NO: 32822
  hemagglutinin__InfluenzaA__ACF22276

SEQ ID NO: 32829 - RNA, 1701 nt, Artificial Sequence; identical to SEQ ID NO: 32822
  hemagglutinin__InfluenzaA__ACF22287

SEQ ID NO: 32830 - RNA, 1701 nt, Artificial Sequence; identical to SEQ ID NO: 32822
  hemagglutinin__InfluenzaA__ACF22298

SEQ ID NO: 32831 - RNA, 1701 nt, Artificial Sequence; identical to SEQ ID NO: 32822
  hemagglutinin__InfluenzaA__ACF22320

SEQ ID NO: 32832 - RNA, 1701 nt, Artificial Sequence
  hemagglutinin__InfluenzaA__ACF22342
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggugcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32833 - RNA, 1701 nt, Artificial Sequence
  hemagglutinin__InfluenzaA__ACF22364
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcaggguucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32834 - RNA, 1701 nt, Artificial Sequence
  hemagglutinin__InfluenzaA__ACF22408
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaauuuaacaaugaaagcuucaauuggacuggagucacucaaaacggaacaagcucugcuugcauaaggagaacuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32835 - RNA, 1701 nt, Artificial Sequence; identical to SEQ ID NO: 32472
  hemagglutinin__InfluenzaA__ACF41669

SEQ ID NO: 32836 - RNA, 1698 nt, Artificial Sequence; identical to SEQ ID NO: 32761
  hemagglutinin__InfluenzaA__ACF41680

SEQ ID NO: 32837 - RNA, 1689 nt, Artificial Sequence
  hemagglutinin__InfluenzaA__ACF41691
auggccaucauuuaucucauacuccuguucacagcagugaggggggaccagauaugcauuggauaccaugccaauaauuccacagaaaaggucgacacaauucuagagcggaaugucacugugacucaugccaaggacauccuugagaagacccauaacggaaagcuaugcaaacuaaacggaauuccuccacuugaacuaggggauuguagcauugccggauggcuccuuggaaauccagaaugugauaggcuucuaagggugccagaaugguccuauauaauggagaaagaaaacccgagauacaguuuguguuauccaggcagcuucaaugacuaugaagaauugaaacaucuccucaguagcguaaaacacuucgagaaaguaaagauucugccaaaagauggauggacacagcaugagacagauggagguucaaaggccugcgcagugucagguaaaccaucauucuucaggaacauggucuggcugacaaagaaaggaccuaauuauccgguugccaaaagaucguacaacaauacgagcggagagcaaaugcuaauaauuuggggagugcaccauccuaaugaugaggcagaacaaagagcauuguaccaggaagugggaaccuauguuuccgcaagcacaucaacauuaaacaaaaggucaaccccagaaauagcagcaaggccuaaagugaguggacuaggaaguagaauggaauucucuuggacccucuuggaugugugggacaccauaaguuuugagagcacugguaaucuaguugcaccagaguauggauucaaaauaucgaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcuggcuuuauagaaggaggauggcaaggaaugguugaugguugguauggauaccaucacagcaaugaccagggaucaggguaugcagcagacaaagaauccacucaaaaggcauuugacagaaucaccaacaagguaaauucugugauugaaaagaugaacacccaauuugaagcuguugggaaagaauucaguaacuuagagaaaagacuggaaaacuugaacaaaaagauggaagacggguuucuagauguguggacauacaaugcugagcuucuaguucugauggaaaaugagaggacacuugacuuucaugauucuaaugucaagaaccuguaugauaaagucagaaugcagcugagagacaacgucaaagaacuaggaaauggauguuuugaauuuuaucauaaaugugacgaugaaugcaugaauagugugaaaaaugggacguaugauuaucccaaguaugaagaagaaucuaaacuaaagagaaaugaaaucaaagggguggaauugagcagcauggggguuuaccaaauucuugccauuuaugcuacaguugcagguucucugucacuggcaaucaugauagcugggaucucuuucuggaugugcuccaacgggucucugcagugcagaaucugcauauga

SEQ ID NO: 32838 - RNA, 1701 nt, Artificial Sequence; identical to SEQ ID NO: 32820
  hemagglutinin__InfluenzaA__ACF41735

SEQ ID NO: 32839 - RNA, 1701 nt, Artificial Sequence
  hemagglutinin__InfluenzaA__ACF41790
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggauuucacuuggacuggggucacucagaaugggggaagcaaugcuugcaaaaggggaccugguagcgguuuuuucaguagacugaacugguugaccaaaucaggaagcacauauccagugcuggacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32840 - RNA, 1701 nt, Artificial Sequence
  hemagglutinin__InfluenzaA__ACF41823
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccggcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccauaauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32841 - RNA, 1698 nt, Artificial Sequence
  hemagglutinin__InfluenzaA__ACF41834
augaaggcaaaccuacugguccuguuaugugcacuugcagcugcagaugcagacacaauauguauaggcuaccaugcgaacaauucaaccgacacuguugacacaguacucgagaagaaugugacagugacacacucuguuaaccugcucgaagacagccacaacggaaaacuauguagauuaaaaggaauagccccacuacaauuggggaaauguaacaucgccggauggcucuugggaaacccagaaugcgacccacugcuuccagugagaucaugguccuacauuguagaaacaccaaacucugagaauggaauauguuauccaggagauuucaucgacuaugaggagcugagggagcaauugagcucagugucaucauucgaaagauucgaaauauuucccaaagaaagcucauggcccaaccacaacacaaacggaguaacggcagcaugcucccaugaggggaaaagcaguuuuuacagaaauuugcuauggcugacggagaaggagggcucauacccaaaucugaaaaauucuuaugugaacaaaaaagggaaagaaguccuuguacugugggguauucaucacccgucuaacaguaaggaacaacagaaucucuaucagaaugaaaaugcuuaugucucuguagugacuucaaauuauaacaggagauuuaccccggaaauagcagaaagacccaaaguaagagaucaagcugggaggaugaacuauuacuggaccuugcuaaaacccggagacacaauaauauuugaggcaaauggaaaucuaauagcaccaauguaugcuuucgcacugaguagaggcuuuggguccggcaucaucaccucaaacgcaucaaugcaugaguguaacacgaagugucaaacaccccugggagcuauaaacagcagucucccuuaccagaauauacacccagucacaauaggagagugcccaaaauacgucaggagugccaaauugaggaugguuacaggacuaaggaacauuccguccauucaauccagaggucuauuuggagccauugccgguuuuauugaagggggauggacuggaaugauagauggaugguaugguuaucaucaucagaaugaacagggaucaggcuaugcagcggaucaaaaaagcacacaaaaugccauuaacgggauuacaaacaaggugaacacuguuaucgagaaaaugaacauucaauucacagcuguggguaaagaauucaacaaauuagaaaaaaggauggaaaauuuaaauaaaaaaguugaugauggauuucuggacauuuggacauauaaugcagaauuguuaguucuacuggaaaaugaaaggacucuggauuuccaugacucaaaugugaagaaucuguaugagaaaguaaaaagccaauuaaagaauaaugccaaagaaaucggaaauggauguuuugaguucuaccacaagugugacaaugaaugcauggaaaguguaagaaaugggacuuaugauuaucccaaauauucagaagagucaaaguugaacagggaaaagguagauggagugaaauuggaaucaauggggaucuaucagauucuggcgaucuacucaacugucgccaguucacuggugcuuuuggucucccugggggcaaucaguuucuggauguguucuaauggaucuuugcagugcagaauaugcaucuga

SEQ ID NO: 32842 - RNA, 1701 nt, Artificial Sequence
  hemagglutinin__InfluenzaA__ACF41856
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugauguaccggauuaugccucccuuaggucacuaguugccucaucaggcacccuggaguuuaucaaugaagacuucaauuggacuggagucgcucaggaugggggaagcuaugcuugcaaaaggggaucuguuaacaguuucuuuaguagauugaauugguugcacaaaucagaauacaaauauccagcgcugaacgugacuaugccaaacaauggcaaauuugacaaauuguacauuugggggguucaccacccgagcacggacagagaccaaaccagccuauauguucgagcaucagggagagucacagucucuaccaaaagaagccaacaaacuguaaccccgaauaucgggucuagacccuggguaaggggucaguccaguagaauaagcaucuauuggacaauaguaaaaccgggagacauacuuuugauuaauagcacagggaaucuaauugcuccucgggguuacuucaaaauacgaaaugggaaaagcucaauaaugaggucagaugcacccauuggcaccugcaguucugaaugcaucacuccaaauggaagcauucccaaugacaaaccuuuucaaaauguaaacaggaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 32843 - RNA, 1698 nt, Artificial Sequence
  hemagglutinin__InfluenzaA__ACF41867
augaaagcaaaacuacuaguccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaaucacugauuucuaaggaaucaugguccuacauuguagagacaccaaacccugagaauggaacauguuacccaggguauuucgccgacuaugaggaacugagggagcaauugaguucaguaucaucauuugagagauucgaaauauuccccaaagaaagcucauggcccaaccacaccguaacaggaguaacggcaucaugcucccauaaugggaaaagcaguuuuuacagaaauuugcuauggcugacggagaagaauggcuuguacccaaaucugagcaauuccuaugugaacaacaaagagaaagaaguccuuguacuaugggguguucaucacccaucuaacauaagggaccaaagggccaucuaucauacagaaaacgcuuaugucucuguagugucuucacauuauagcagaagauucaccccagaaauagcaaaaagacccaaaguaagaggucaggaaggaagaaucaacuacuacuggacucugcuggaacccggggacacaauaauauuugaggcaaauggaaaucuaauagcgccaugguaugcuuucgcacugaguagaggcuuugggucaggaaucaucaccucaaaugcaccaaugaaugaaugugaugcgaagugucaaacaccucagggagcuauaaacaguagucuuccuuuccagaauguacacccagucacaauaggagaguguccaaaguaugucaggaguacaaaauuaaggaugguuacaggacuaaggaauaucccauccauucaauccagagguuuguuuggagccauugccgguuucauugaagggggguggacuggaaugauggaugggugguaugguuaucaucaucagaaugagcaaggaucuggcuaugcugcagaucaaaaaagcacacaaaaugccauuaacgggauuacaaauaaggugaauucuguaauugagaaaaugaacacucaauucacagcugugggcaaagaauucaacaaauuagaaagaaggauggaaaacuuaaauaaaaaaguugaugauggauuucuagacauuuggacauauaaugcagaauuguugguucuacuggaaaaugaaaggacuuuggauuuccaugacucaaaugugaagaaucuguaugagaaagugaaaagccaauuaaagaauaaugccaaagaaauagggaacggguguuuugaauucuaucacaaguguaacaaugaaugcauggaaagugugaaaaauggaacuuaugacuauccaaaauauuccgaagaaucaaaguuaaacagggagaaaauugauggagugaaauuggaaucaaugggagucuaucagauucuggcgaucuacucaacugucgccaguucacugguucuuuuggucucccugggggcaaucagcuucuggauguguuccaaugggucuuugcaguguagaauaugcaucuga

SEQ ID NO: 32844 - RNA, 1698 nt, Artificial Sequence; identical to SEQ ID NO: 32619
  hemagglutinin__InfluenzaA__ACF41878

SEQ ID NO: 32845 - RNA, 1701 nt, Artificial Sequence
  hemagglutinin__InfluenzaA__ACF41922
augaaagcaaaacuacuaguccuguuaugugcauuuacagcuacauaugcagacacaauauguauaggcuaccaugcgaacaacucaaccgacacuguugacacaguacuugagaagaacgugacagugacacacucugucaaccuacuugaggacagucacaacggaaaacuaugucgacuaaagggaauagccccacuacaauuggguaauugcagcguugccggauggaucuuaggaaacccaaaaugcgaaucacuguuuucuaaggaaucaugguccuacauugcagaaacaccaaacccugagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcaucaugcucccauaaugggaaaagcaguuuuuacagaaauuugcuauggcugacggagaagaauggcuuguacccaaaucugagcaaguccuauguaaacaacaaagagaaagaaguccuuguacuaugggguguucaucacccgucuaacauaagggaccaaagggccaucuaucauacagaaaaugcuuaugucucuguagugucuucacauuauagcagaagauucaccccagaaauagcaaaaagacccaaaguaagagaucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagaguguccaaaguaugucaggaguacaaaauuaaggaugguuacaggacuaaggaacaucccauccauucaauccagagguuuguuuggagccauugccgguuucauugaagggggguggacuggaaugauagauggaugguaugguuaucaucaucagaaugaacaaggaucuggcuaugcugcggaccaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaauggaaggacuuuggauuuucaugacucaaaugugaagaaucuguaugagaaaguaaaaagccaauugaagaauaaugccaaagaaauagggaacggguguuuugaauucuaucacaaguguaacaaugaaugcauggaaagugugaaaaauggaacuuaugacuauccaaaauauuccgaagaaucaaaguuaaacaggggaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 32846 - RNA, 1689 nt, Artificial Sequence
  hemagglutinin__InfluenzaA__ACF54389
auggccaucauuuaucucauacuccuguucgcaacagugaggggggaccagauaugcauuggauaccaugccaauaauuccacagaaaaggucgacacaauucuagagcggaaugucacugugacucaugccaaggacauccuugagaagacccacaacgggaagcuaugcaaacuaaacggaaucccuccacuugaacuaggggacuguagcauugccggauggcuccuuggaaauccagaaugugauaggcuucuaagggugccagaaugguccuauauaauggagaaagaaaacccaagguacaguuuguguuacccaggcagcuuaaaugacuaugaagaauugaaacaucuccucagcagcguaaaacauuucgagaaaguaaggauucugcccaaagauagauggacacagcauacaacaacuggagguucaaaggccugugcagugucaggcaaaccaucauucuucaggaacauggucuggcugacaaagaaaggaacaaauuauccgguugccaaaggaucguacaacaauacgagcggagagcaaaugcuaauaauuuggggagugcaccauccuauugaugaggcagaacaaagagcauuguaccaggaagugggaaccuauguuuccgcaagcacuucaacauugaacaaaaggucaaucccugaaauagcagcaaggccugaagugaauggacuuggaaguagaauggaauucucuuggacccuuuuggauguaugggacaccauaaauuuugagagcacugguaaucuaguugcaccagaguauggauucaaaauaucaaaaagagguaguucagggaucaugaagacagaaggaacacuugggaacugugagaccaaaugccaaacuccuuugggagcaauaaauacaacacuaccuuuccacaauguccacccacugacaauaggcgaaugccccaaauauguaaaaucggagaaauugguccuagcaacaggacuaaggaauguuccccaaauugaaucaagaggauuguuuggggcaauagcuggcuuuauagaaggaggauggcaaggaaugguugaugguugguauggauaccaucacagcaaugaacagggaucaggguaugcagcagacaaagaauccacucaaaaggcauuugauggaaucaccaacaaggugaauucugugauugaaaagaugaacacccaauuugaagcuguugggaaagaauucaauaauuuagagaaaagacuggagaacuugaacaaaaagauggaagacggguuccuagauguguggacauacaaugcugagcuucuaguucugauggaaaaugagaggacacuugacuuccaugauucuaauguaaaaaaccuguaugaaaaagucagaaugcagcugagagacaacgucaaagaacuaggaaauggauguuuugaauuuuaucacaaaugugacgaugaaugcaugaauagugugaaaaacggaacguaugauuaucccaaguaugaagaagaaucuaaacuaaagagaaaugaaaucaaagggguaaaauugagcagcauggggguuuaccaaauucuugccauuuaugcuacaguugcagguucucugucacuggcaaucaugguggcugggaucucuuucuggaugugcuccaacgggucucugcagugcagaaucugcauauga

SEQ ID NO: 32847 - RNA, 1701 nt, Artificial Sequence; identical to SEQ ID NO: 32820
  hemagglutinin__InfluenzaA__ACF54400

SEQ ID NO: 32848 - RNA, 1701 nt, Artificial Sequence; identical to SEQ ID NO: 32823
  hemagglutinin__InfluenzaA__ACF54411

SEQ ID NO: 32849 - RNA, 1701 nt, Artificial Sequence; identical to SEQ ID NO: 32822
  hemagglutinin__InfluenzaA__ACF54422

SEQ ID NO: 32850 - RNA, 1701 nt, Artificial Sequence
  hemagglutinin__InfluenzaA__ACF54433
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuagaucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32851 - RNA, 1701 nt, Artificial Sequence
  hemagglutinin__InfluenzaA__ACF54444
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugacggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32852 - RNA, 1701 nt, Artificial Sequence; identical to SEQ ID NO: 32840
  hemagglutinin__InfluenzaA__ACF54466

SEQ ID NO: 32853 - RNA, 1689 nt, Artificial Sequence
  hemagglutinin__InfluenzaA__ACF54477
auggccaucauuuaucucauucuccuguucacagcagugagaggggaccagauaugcauuggauaccaugccaauaauuccacagagaaggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggaaguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32854 - RNA, 1689 nt, Artificial Sequence
  hemagglutinin__InfluenzaA__ACF54499
auggccaucauuuaucucauucuccuguucacagcagugagaggggaccagauaugcauuggauaccaugccaauaauuccacagagacggucgacacaauucuagagcggaacgucacugugacucaugccaaggacauucuugagaagacccauaacggaaaguuaugcaaacuaaacggaaucccuccacuugaacuaggggacuguagcauugccggauggcuccuuggaaauccagaaugugauaggcuucuaagugugccagaaugguccuauauaauggagaaagaaaacccgagagacgguuuguguuauccaggcagcuucaaugauuaugaagaauugaaacaucuccucagcagcgugaaacauuucgagaaaguaaagauucugcccaaagauagauggacacagcauacaacaacuggagguucacgggccugcgcggugucugguaauccaucauucuucaggaacauggucuggcugacaaagaaaggaucaaauuauccgguugccaaaggaucguacaacaauacaagcggagaacaaaugcuaauaauuuggggggugcaccaucccaaugaugagacagaacaaagaacauuguaccagaaugugggaaccuauguuuccguaggcacaucaacauugaacaaaaggucaaccccagacauagcaacaaggccuaaagugaauggacuaggaaguagaauggaauucucuuggacccuauuggauaugugggacaccauaaauuuugagaguacugguaaucuaauugcaccagaguauggauucaaaauaucgaaaagagguaguucagggaucaugaaaacagaaggaacacuugagaacugugagaccaaaugccaaacuccuuugggagcaauaaauacaacauugccuuuucacaauguccacccacugacaauaggugagugccccaaauauguaaaaucggagaaguuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagagaagacuggagaacuugaacaaaaagauggaagacggguuucuagauguguggacauacaaugcugagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugaugaugaaugcaugaauagugugaaaaacgggacguaugauuaucccaaguaugaagaagagucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcaggaucugcauauga

SEQ ID NO: 32855 - RNA, 1689 nt, Artificial Sequence; identical to SEQ ID NO: 32854
  hemagglutinin__InfluenzaA__ACF54510

SEQ ID NO: 32856 - RNA, 1689 nt, Artificial Sequence; identical to SEQ ID NO: 32854
  hemagglutinin__InfluenzaA__ACF54521

SEQ ID NO: 32857 - RNA, 1701 nt, Artificial Sequence
  hemagglutinin__InfluenzaA__ACF54532
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguauauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggugcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugacgucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32858 - RNA, 1701 nt, Artificial Sequence
  hemagglutinin__InfluenzaA__ACF54543
augaagacuaucauugcuuuaagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggaucugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32859 - RNA, 1701 nt, Artificial Sequence
  hemagglutinin__InfluenzaA__ACF54565
augaagacuaucauugcuuuaagcuacauucuaugucugguuuucucucaaaagcuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucagaauggaacaagcucugcuugcaaaaggagaucuaauaaaaguuucuuuaguagauugaauugguugacccacuuaaaauacaaauacccagcauugaacgugacuaugccaaacaaugaaaaauuugacaaauuguacauuugggggguucaccacccgguuacggacagugaccaaaucagccuauaugcucaagcaucaggaagaaucacagucucuaccaaaagaagccaacaaacuguaaucccgaauaucggauauagacccaggguaagggauaucuccagcagaauaagcaucuauuggacaauaguaaaaccgggagacauacuuuugauuaacagcacaggaaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggacgguugguacgguuucaggcaucaaaauucugagggcacaggacaagcagcagaucucaaaagcacucaagcagcaaucaaccaaaucaaugggaaacugaauagguuaaucgggaaaacaaacgagaaauuccaucagauugaaaaagaauucucagaaguagaagggagaauucaggaccucgagaaauauguugaggacacuaaaauagaucucuggucauacaacgcggagcuucuuguugcccuggaaaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagagucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32860 - RNA, 1701 nt, Artificial Sequence
  hemagglutinin__InfluenzaA__ACF54576
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacgaugaaagcuucaauuggacuggagucacucaaaauggaacaagcucuucuugcaaaaggagaucuaauaacaguuucuuuaguagauugaauugguugacccaauuaaaauucaaauacccagcauugaacgugacuaugccaaacaaugaaaaauuugacaaauuguacauuugggggguucaccacccgguuacggacaaugaccaaaucuuccuguaugcucaagcaucaggaagaaucacagucucuaccaaaagaagccaacaaacuguaaucccgaauaucggaucuagacccagaauaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32861 - RNA, 1698 nt, Artificial Sequence
  hemagglutinin__InfluenzaA__ACF54598
augaaggcaaaacuacugguccuguuauaugcauuuguagcuacagaugcagacacaauauguauaggcuaccaugcgaacaacucaaccgacacuguugacacaauauucgagaagaauguggcagugacacauucuguuaaccugcucgaagacagacacaacgggaaacuauguaaauuaaaaggaauagccccacuacaauuggggaaauguaacaucaucggauggcucuugggaaauccagaaugcgacucacugcuuccagcgagaucaugguccuacauuguagaaacaccaaacucugagaauggagcauguuauccaggagauuucaucgacuaugaggaacugagggagcaauugagcucaguaucaucauuagaaagauucgaaauauuucccaaggaaaguucauggcccaaccacacauucaacggaguaacagcaucaugcucccauaggggaaaaagcaguuuuuacagaaauuugcuauggcugacgaagaagggggauucauacccaaagcugaccaauuccuaugugaacaauaaagggaaagaaguccuuguacuaugggguguucaucacccgucuagcagugaugagcaacagagucucuauaguaauggaaaugcuuaugucucuguagcgucuucaaauuauaacaggagauucaccccggaaauagcugcaaggcccaaaguaaaagaucaacaugggaggaugaacuauuacuggaccuugcuagaacccggagacacaauaauauuugaggcaacugguaaucuaauagcaccaugguaugcuuucgcacugaguagaggguuugaguccggcaucaucaccucaaacgcgucaaugcaugaguguaacacgaagugucaaacaccccagggaucuauaaacagcaaucucccuuuccagaauauacacccagucacaauaggagagugcccaaaauaugucaggaguaccaaauugaggaugguuacaggacuaagaaacaucccauccauucaauacagaggucuauuuggagccauugcugguuuuauugaggggggauggacuggaaugauagauggaugguaugguuaucaucaucagaaugaacagggaucaggcuaugcagcggaucaaaaaagcacacagaaugccauuaacgggauuacaaacaaggugaacucuauuaucgagaaaaugaacacucaauucacagcuguggguaaagaauucaacaacuuagaaaaaaggauggaaaauuuaaauaaaaaaguugaugauggguuucuggacauuuggacauauaaugcagaauuguuaguucuacuggaaaauggaagaacuuuggauuuccaugacuuaaaugugaagaaucuguacgagaaaguaaaaagccaauuaaagaauaaugccaaagaaaucggaaauggguguuuugaguucuaccacaagugugacaaugaaugcauggaaaguguaagaaaugggacuuaugauuauccaaaauauucagaagaaucaaaguugaacagggaaaagauagauggagugaaauuggaaucaauggggguguaucagauucuggcgaucuacucaacugucgccaguucacuggugcuuuuggucucccugggggcaaucaguuucuggauguguucuaaugggucuuugcagugcagaauaugcaucuga

SEQ ID NO: 32862 - RNA, 1704 nt, Artificial Sequence
  hemagglutinin__InfluenzaA__ACG50699
auggagaaaauaguacuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacggaaagcucugcgaucuagauggagugaagccucugauuuuaagagauuguaguguagcuggauggcuccucggaaacccaaugugugacgaauucaucaauguaccggaauggucuuacaugguggagaaagccaauccagccaaugaccucuguuacccaggaaauuucaacgacuaugaagaacugaaacaccuauugagcagaauaaaccauuuugagaaaauacagaucauccccaagaguucuugguccgaucaugaagccucauugggggugagcucagcauguccauaccagggaaguuccuccuuuuucagaaaugugguauggcuuaucaaaaagaacaaugcauacccaacaauaaagaggagcuacaauaauaccaaccaagaagaucucuugguauugugggggauucaccauccuaaugaugaggcagagcagacaaggcucuaucagaauccaaccaccuauauuuccguugggacaucaacacuaaaccagagauugauaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggagacucggcaauuaugaaaagugaaguggaauaugguaacugcaacaccaagugucaaacuccaaugggggcgauaaacucuaguaugccauuccacaacauacacccucucaccaucggggaaugucccaaauaugugaaaucaaacaaauuaguucuugcgacugggcucagaaauagcccucaaagagagagaagaagaaaaagaggacuauuuggagcuauagcagguuuuauagagggaggauggcagggaaugguagaugguugguauggguaccaccauagcaaugagcaggggaguggguaugcugcagacaaagaauccacucaaaaagcaauagauggagucaccaauaaggucaacucgaucauugacaaaaugaacacucaguuugaggccguuggaagggaauuuaauaacuuagaaaggagaauagagaauuuaaacaagaagauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuuugaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacuaucaauuuauucaacaguggcgaguucccuagcacuggcaaucaugguggcuggucuaucuuuauggaugugcuccaauggguccuuacaaugcagaauuugcauuuaa

SEQ ID NO: 32863 - RNA, 1701 nt, Artificial Sequence; identical to SEQ ID NO: 32472
  hemagglutinin__InfluenzaA__ACG70142

SEQ ID NO: 32864 - RNA, 1701 nt, Artificial Sequence
  hemagglutinin__InfluenzaA__ACG70153
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauuccaaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucaggaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32865 - RNA, 1701 nt, Artificial Sequence
  hemagglutinin__InfluenzaA__ACG80410
augaagacuaucauugcuuugagcuacauucuaugucugguuuucgcucaaaaacuuccuggaaaugacaacagcacggcaacgcugugccuugggcaccaugcaguaccaaacggaacaauagugagaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaagauucaaauacccagcauugaaugugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32866 - RNA, 1701 nt, Artificial Sequence
  hemagglutinin__InfluenzaA__ACG80420
augcagacuaucauugcuuugagcuacauucuaugucugguuuucgcucaaaaacuuccuggaaaugacaacagcacggcaacgcugugccuugggcaccaugcaguaccaaacggaacaauagugagaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaagauucaaauacccagcauugaaugugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaaaucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32867 - RNA, 1701 nt, Artificial Sequence; identical to SEQ ID NO: 32865
  hemagglutinin__InfluenzaA__ACG80426

SEQ ID NO: 32868 - RNA, 1701 nt, Artificial Sequence; identical to SEQ ID NO: 32865
  hemagglutinin__InfluenzaA__ACG80430

SEQ ID NO: 32869 - RNA, 1701 nt, Artificial Sequence
  hemagglutinin__InfluenzaA__ACG80436
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuaccaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaauuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuugagauucaaauacccagcauugaacgugacuaugccaaacaaugaaaauuuugacaaauuguacauuugggggguccaccacccggguacggacaaugaccaaaucuucuuguaugcucaagcaucaggaagaaucacagucucuaccaaaagaagccaacaaacuguaaucccgaauaucggauccagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuuccggcaucaaaauucugagggaauaggacaagcagcagaucucaaaagcacucaagcagcacucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacaauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32870 - RNA, 1701 nt, Artificial Sequence
  hemagglutinin__InfluenzaA__ACG80445
augaagacuaucauugcuuugagcuacauucuaugucugguuuucgcucaaaaacuuccuggaaaugacaacagcacggcaacgcugugccuugggcaccaugcaguaccaaacggaacaauagugagaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaagauucaaauacccagcauugaaugugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaaugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaaucaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32871 - RNA, 1701 nt, Artificial Sequence; identical to SEQ ID NO: 32865
  hemagglutinin__InfluenzaA__ACG80454

SEQ ID NO: 32872 - RNA, 1701 nt, Artificial Sequence; identical to SEQ ID NO: 32865
  hemagglutinin__InfluenzaA__ACG80463

SEQ ID NO: 32873 - RNA, 1701 nt, Artificial Sequence
  hemagglutinin__InfluenzaA__ACG80472
augaagacuaucauugcuuugagcuacauucuaugucugguuuucgcucaaaaacuuccuggaaaugacaacagcacggcaacgcugugccuugggcaccaugcaguaccaaacggaacaauagugagaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcauaaggagaucuaauaacaguuucuuuaguagauugaauugguugacccacuuaagauucaaauacccagcauugaaugugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggauccagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuuccggcaucaaaauucugagggaauaggacaagcagcagaucucaaaagcacucaagcagcacucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacaauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32874 - RNA, 1701 nt, Artificial Sequence
  hemagglutinin__InfluenzaA__ACH69558
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaagauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32875 - RNA, 1701 nt, Artificial Sequence
  hemagglutinin__InfluenzaA__ACH69569
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcaacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucugaugcacccauuggcaaaugcaauucugaaugcaucacuccaaauggaagcauucccaaugacaaaccauuucaaaauguaaacaggaucacauauggggccugucccagauauguuaagcaaaacucucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaucacaaaugugacaaugccugcauaggaucaaucagaaauggaacuuaugaccaugauguauacagagaugaagcauuaaacaaccgguuccagaucaaaggcgucgagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32876 - RNA, 1701 nt, Artificial Sequence
  hemagglutinin__InfluenzaA__ACH69580
augaagacuaucauugcuuugagcuacauucuaugucugguuuucgcucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacagguggaauaugcgacaguccucaucagauccuugauggagaaaacugcacacuaauagaugcucuauugggagacccucagugugaugacuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaauggaacaagcucugcuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccaggguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaucaaaucaaugggaagcugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauaggaucaaucagaaauggaacuuaugaccaugauguauacagagaugaagcauuaaacaaccgguuccagaucaaaggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32877 - RNA, 1701 nt, Artificial Sequence
  hemagglutinin__InfluenzaA__ACH69591
augaagacuaucauugcuuugagcuacauuuuaugucuggcuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaacaguuucuuuaguagauugaauugguugcaccaauuaaaauacagauauccagcacugaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauaaguuaaucgagaaaacgaacgagaaauuccaucaaauugaaaacgaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 32878 - RNA, 1701 nt, Artificial Sequence
  hemagglutinin__InfluenzaA__ACH69602
augaagacuaucauugcuuugagcuacauuuuaugucuggcuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccaaauccuugauggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaacaguuucuuuaguagauugaauugguugcaccaauuaaaauacagauauccagcacugaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacgguuucaggcaucaaaauucugagggcacaggacaagcagcagaucuuaaaagcacucaagcagcaaucaaccaaaucaacgggaaacugaauaaguuaaucgagaaaacgaacgagaaauuccaucaaauugaaaaagaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 32879 - RNA, 1701 nt, Artificial Sequence
  hemagglutinin__InfluenzaA__ACH69613
augaagacuaucauugcuuugagcuacauuuuaugucuggcuuucgcucaaaaacuucccggaaaugacaacagcacgccaacgcugugccugggacaccaugcagugccaaacggaacgcuagugaaaacaaucacgaaugaccaaauugaagugacuaaugcuacugagcugguucagaguuccucaacagguggaauaugcgacaguccucaccaaaucauugacggagaaaacugcacacugauagaugcucuauugggagacccacauugugauggcuuccaaaauaaggaaugggaccuuuuuguugaacgcagcaaagccuacagcaacuguuacccuuaugaugugccggauuaugccucccuuaggucacuaguugccucauccggcacccuggaguuuaacaaugaaagcuucaauuggacuggagucgcucagaauggaacaagcucugcuugcaaaaggagaucuauuaacaguuucuuuaguagauugaauugguugcaccaauuaaaauacagauauccagcacugaacgugacuaugccaaacaaugacaaauuugacaaauuguacauuugggggguucaccacccgaguacggacagugaccaaaucagcguauaugcccaagcaucagggagagucacagucucuaccaaaagaagccaacaaacuguaaucccgaauaucggauccagacccuggguaagggguaucuccagcagaauaagcaucuauuggacaauaguaaaaccgggagacauacuuuugauuaacagcacagggaauccaauugcuccucgggguuacuucaaaauacgaagugggaaaagcucaauaaugaggucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcggguuucauagaaaaugguugggagggaaugauggacgguugguacggucucaggcaucaaaauucugagggcacaggacaggcagcagaucuuaaaagcacucaagcagcaaucaaccaaaucaacgggaaacugaauaaguuaaucgagaaaacgaacgagaaauuccaucaaauugaaaacgaauucucagaaguagaagggagaauucaggaccucgagaaauauguugaggacacuaaaauagaucucuggucguacaacgcggagcuucuuguugcccuggagaaccaacauacaauugaucuaacugacucagaaaugaacaaacuguuugaaagaacaaggaagcaacugagagaaaaugcugaggauaugggcaaugguuguuucaaaauauaccacaaaugugacaaugccugcauagggucgaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucauuaugugggccugccaaaaaggcaacauuaggugcaacauuugcauuuga

SEQ ID NO: 32880 - RNA, 1701 nt, Artificial Sequence; identical to SEQ ID NO: 31139
  hemagglutinin__InfluenzaA__ACH82060

SEQ ID NO: 32881 - RNA, 1701 nt, Artificial Sequence; identical to SEQ ID NO: 32820
  hemagglutinin__InfluenzaA__ACI06123

SEQ ID NO: 32882 - RNA, 1701 nt, Artificial Sequence; identical to SEQ ID NO: 32820
  hemagglutinin__InfluenzaA__ACI06126

SEQ ID NO: 32883 - RNA, 1701 nt, Artificial Sequence; identical to SEQ ID NO: 32820
  hemagglutinin__InfluenzaA__ACI06127

SEQ ID NO: 32884 - RNA, 1701 nt, Artificial Sequence; identical to SEQ ID NO: 32820
  hemagglutinin__InfluenzaA__ACI06129

SEQ ID NO: 32885 - RNA, 1701 nt, Artificial Sequence; identical to SEQ ID NO: 32820
  hemagglutinin__InfluenzaA__ACI06130

SEQ ID NO: 32886 - RNA, 1701 nt, Artificial Sequence; identical to SEQ ID NO: 32821
  hemagglutinin__InfluenzaA__ACI06132

SEQ ID NO: 32887 - RNA, 1701 nt, Artificial Sequence; identical to SEQ ID NO: 32822
  hemagglutinin__InfluenzaA__ACI06133

SEQ ID NO: 32888 - RNA, 1701 nt, Artificial Sequence; identical to SEQ ID NO: 32823
  hemagglutinin__InfluenzaA__ACI06134

SEQ ID NO: 32889 - RNA, 1701 nt, Artificial Sequence; identical to SEQ ID NO: 32822
  hemagglutinin__InfluenzaA__ACI06135

SEQ ID NO: 32890 - RNA, 1701 nt, Artificial Sequence; identical to SEQ ID NO: 32823
  hemagglutinin__InfluenzaA__ACI06136

SEQ ID NO: 32891 - RNA, 1701 nt, Artificial Sequence; identical to SEQ ID NO: 32823
  hemagglutinin__InfluenzaA__ACI06137

SEQ ID NO: 32892 - RNA, 1701 nt, Artificial Sequence; identical to SEQ ID NO: 32823
  hemagglutinin__InfluenzaA__ACI06138

SEQ ID NO: 32893 - RNA, 1701 nt, Artificial Sequence; identical to SEQ ID NO: 32823
  hemagglutinin__InfluenzaA__ACI06139

SEQ ID NO: 32894 - RNA, 1701 nt, Artificial Sequence; identical to SEQ ID NO: 32822
  hemagglutinin__InfluenzaA__ACI06140

SEQ ID NO: 32895 - RNA, 1701 nt, Artificial Sequence; identical to SEQ ID NO: 32822
  hemagglutinin__InfluenzaA__ACI06141

SEQ ID NO: 32896 - RNA, 1701 nt, Artificial Sequence; identical to SEQ ID NO: 32822
  hemagglutinin__InfluenzaA__ACI06142

SEQ ID NO: 32897 - RNA, 1701 nt, Artificial Sequence; identical to SEQ ID NO: 32822
  hemagglutinin__InfluenzaA__ACI06143

SEQ ID NO: 32898 - RNA, 1701 nt, Artificial Sequence
  hemagglutinin__InfluenzaA__ACI06144
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcccuggagaaucaacauacaauugaccugacugacucggaaaugaacaggcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32899 - RNA, 1701 nt, Artificial Sequence; identical to SEQ ID NO: 32822
  hemagglutinin__InfluenzaA__ACI06145

SEQ ID NO: 32900 - RNA, 1701 nt, Artificial Sequence
  hemagglutinin__InfluenzaA__ACI06146
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagccccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauuaugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32901 - RNA, 1701 nt, Artificial Sequence; identical to SEQ ID NO: 32822
  hemagglutinin__InfluenzaA__ACI06147

SEQ ID NO: 32902 - RNA, 1701 nt, Artificial Sequence; identical to SEQ ID NO: 32832
  hemagglutinin__InfluenzaA__ACI06148

SEQ ID NO: 32903 - RNA, 1701 nt, Artificial Sequence
  hemagglutinin__InfluenzaA__ACI06149
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccggcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32904 - RNA, 1701 nt, Artificial Sequence
  hemagglutinin__InfluenzaA__ACI06151
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32905 - RNA, 1701 nt, Artificial Sequence; identical to SEQ ID NO: 32833
  hemagglutinin__InfluenzaA__ACI06152

SEQ ID NO: 32906 - RNA, 1701 nt, Artificial Sequence
  hemagglutinin__InfluenzaA__ACI06153
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacgaacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32907 - RNA, 1701 nt, Artificial Sequence
  hemagglutinin__InfluenzaA__ACI06155
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauagugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32908 - RNA, 1701 nt, Artificial Sequence
  hemagglutinin__InfluenzaA__ACI06156
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguuuaucaugugggccugccagagaggcaacauuaggugcaacauuugcauuuga

SEQ ID NO: 32909 - RNA, 1701 nt, Artificial Sequence
  hemagglutinin__InfluenzaA__ACI06157
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32910 - RNA, 1701 nt, Artificial Sequence; identical to SEQ ID NO: 32850
  hemagglutinin__InfluenzaA__ACI06158

SEQ ID NO: 32911 - RNA, 1701 nt, Artificial Sequence
  hemagglutinin__InfluenzaA__ACI06159
augaagaccaucauugcuuugagcuacauuuucugucuggcucucggccaagaucuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32912 - RNA, 1701 nt, Artificial Sequence; identical to SEQ ID NO: 32851
  hemagglutinin__InfluenzaA__ACI06160

SEQ ID NO: 32913 - RNA, 1701 nt, Artificial Sequence
  hemagglutinin__InfluenzaA__ACI06161
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucgaguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaagggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32914 - RNA, 1701 nt, Artificial Sequence
  hemagglutinin__InfluenzaA__ACI06162
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucgaguccagacccuggguaaggggucugucuaguagaauaagcaucuauuggacaauaguuaauccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32915 - RNA, 1701 nt, Artificial Sequence
  hemagglutinin__InfluenzaA__ACI06163
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaagggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32916 - RNA, 1701 nt, Artificial Sequence
  hemagglutinin__InfluenzaA__ACI06164
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaaacaucuauuggacaauaguuaagccgggagacguacugguaauuaauaguaaugggaaccuaaucgcuccucgggguuauuucaaaaugcgcaaugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32917 - RNA, 1701 nt, Artificial Sequence
  hemagglutinin__InfluenzaA__ACI06165
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcaaugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32918 - RNA, 1701 nt, Artificial Sequence
  hemagglutinin__InfluenzaA__ACI06166
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggauaaggggucugucuaguagaauaaacaucuauuggacaauaguuaagccgggagacguacugguaauuaauaguaaugggaaccuaaucgcuccucgggguuauuucaaaaugcgcaaugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32919 - RNA, 1701 nt, Artificial Sequence; identical to SEQ ID NO: 32903
  hemagglutinin__InfluenzaA__ACI06167

SEQ ID NO: 32920 - RNA, 1701 nt, Artificial Sequence
  hemagglutinin__InfluenzaA__ACI06168
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaagcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32921 - RNA, 1701 nt, Artificial Sequence; identical to SEQ ID NO: 32822
  hemagglutinin__InfluenzaA__ACI06169

SEQ ID NO: 32922 - RNA, 1701 nt, Artificial Sequence; identical to SEQ ID NO: 32839
  hemagglutinin__InfluenzaA__ACI06171

SEQ ID NO: 32923 - RNA, 1701 nt, Artificial Sequence
  hemagglutinin__InfluenzaA__ACI06172
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggauuucacuuggacuggggucacucagaaugggggaagcaaugcuugcaaaaggggaccugguagcgguuuuuucaguagacugaacugguugaccaaaucaggaagcacauauccagugcuggacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32924 - RNA, 1701 nt, Artificial Sequence
  hemagglutinin__InfluenzaA__ACI06173
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccaggagaagccagcaaacuauaaucccgaauaucggguccagacccuggguaaggggucugucuaguagaauaagcaucuauuggacaauaguuaagccgggagacguacuggaaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32925 - RNA, 1701 nt, Artificial Sequence; identical to SEQ ID NO: 32839
  hemagglutinin__InfluenzaA__ACI06174

SEQ ID NO: 32926 - RNA, 1701 nt, Artificial Sequence; identical to SEQ ID NO: 32840
  hemagglutinin__InfluenzaA__ACI06175

SEQ ID NO: 32927 - RNA, 1701 nt, Artificial Sequence; identical to SEQ ID NO: 32840
  hemagglutinin__InfluenzaA__ACI06176

SEQ ID NO: 32928 - RNA, 1701 nt, Artificial Sequence; identical to SEQ ID NO: 32840
  hemagglutinin__InfluenzaA__ACI06177

SEQ ID NO: 32929 - RNA, 1689 nt, Artificial Sequence
  hemagglutinin__InfluenzaA__ACI25724
auggccaucauuuaucucauacuccuguucgcaacagugaggggggaccagauaugcauuggauaccaugccaauaauuccacagaaaaggucgacacaauucuagagcggaaugucacugugacucaugccaaggacauccuugagaagacccacaacggaaagcuaugcaaacuaaacggaaucccuccacuugaacuaggggacuguagcauugccggauggcuccuuggaaauccagaaugugauaggcuucuaagggugccagaaugguccuauauaauggagagagaaaacccaagauacaguuuguguuacccaggcagcuuaaaugacuaugaagaauugaaacaucuccucagcagcguaaaacacuucgagaaaguaaggauucugcccaaagauagauggacacagcauacaacaacuggagguucaaaggccugcgcagugucagguaaaccaucauucuucaggaacauggucuggcugacaaagaaaggaccaaauuauccgguugccaaaggaucguacaacaauacgagcggagagcaaaugcuaauaauuuggggagugcaccauccuaaagaugaggcagaacaaagagcauuguaccaggaagugggaaccuauguuuccgcaagcacaucaacauugaacaaaaggucaaucccugaaauagcagcaaggccugaagugaauggacuuggaaguagaauggaauucucuuggacccucuuggauguaugggacaccauaaauuuugagagcacugguaaucuaguugcaccagaguauggauucaaaauaucaaaaagagguaguucagggaucaugaagacagaaggaacacuugggaacugugagaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccaaauugaaucaagaggauuguuuggggcaauagcuggcuuuauagaaggaggauggcaaggaaugguugaugguugguauggauaccaucacagcaaugaccaaggaucaggguaugcagcagacaaagaauccacucaaaaggcauuugauggaaucaccaacaagguaaauucugugauugaaaagaugaacacccaauuugaagcuguugggaaagaauucaauaauuuagagaaaagacuggagaacuugaacaaaaagauggaagacggguuccuagauguguggacauacaaugcugagcuucugguucugauggaaaaugagaggacacuugacuuccaugauucuaauguaaaaaaccuguaugaaaaagucagaaugcagcugagagacaacgucaaagaacuaggaaauggauguuuugaauuuuaucacaaaugugacgaugaaugcaugaauagugugaaaaacggaacguaugauuaucccaaguaugaagaagaaucuaaacuaaagagaaaugaaaucaaagggguaaaauugagcagcauggggguuuaccaaauucuugcuauuuaugcuacaguugcagguucucugucacuggcaaucaugguggcugggaucucuuucuggaugugcuccaacgggucucugcagugcagaaucugcauauga

SEQ ID NO: 32930 - RNA, 1701 nt, Artificial Sequence
  hemagglutinin__InfluenzaA__ACI25746
augaagaccaucauugcuuugagcuacauuuucugucuggcucucggccaauaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauugauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32931 - RNA, 1701 nt, Artificial Sequence
  hemagglutinin__InfluenzaA__ACI25757
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauaucuagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuauaaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32932 - RNA, 1701 nt, Artificial Sequence; identical to SEQ ID NO: 32820
  hemagglutinin__InfluenzaA__ACI25768

SEQ ID NO: 32933 - RNA, 1701 nt, Artificial Sequence
  hemagglutinin__InfluenzaA__ACI25779
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucugguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32934 - RNA, 1701 nt, Artificial Sequence
  hemagglutinin__InfluenzaA__ACI25790
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauagacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggguuucacuuggacuggggucacucagaaugggggaagcaaugcuugcaaaaggggaccugguagcgguuuuuucaguagacugaacugguugaccaaaucaggaagcacauauccagugcugaacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucugguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaagugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32935 - RNA, 1701 nt, Artificial Sequence
  hemagglutinin__InfluenzaA__ACI25801
augaagaccaucauugcuuugagcuacauuuucugucuggcucucggccaagaccuuccaggaaaugacaacagcacagcaacgcugugccugggacaucaugcggugccaaacggaacacuagugaaaacaaucacagaugaucagauugaagugacuaaugcuacugagcuaguucagagcuccucaacggggaaaauaugcaacaauccucaucgaauccuugauggaauaaacugcacacugauagaugcucuauugggggacccucauugugauguuuuucaaaaugagacaugggaccuuuucguugaacgcagcaaagcuuucagcaacuguuacccuuaugaugugccagauuaugccucccuuaggucacuaguugccucgucaggcacucuggaguuuaucacugaggauuucacuuggacuggggucacucagaaugggggaagcaaugcuugcaaaaggggaccugguagcgguuuuuucaguagacugaacugguugaccaaaucaggaagcacauauccagugcuggacgugacuaugccaaacaaugacaauuuugacaaacuauacauuugggggguucaccacccgagcacgaaccaagaacaaaccagccuguauguucaagcaucagggagagucacagucucuaccagaagaagccagcaaacuauaaucccgaauaucggguccagacccuggguaaggggucugucuaguagaauaagcaucuauuggacaauaguuaagccgggagacguacugguaauuaauaguaaugggaaccuaaucgcuccucgggguuauuucaaaaugcgcacugggaaaagcucaauaaugaggucagaugcaccuauugauaccuguauuucugaaugcaucacuccaaauggaagcauucccaaugacaagcccuuucaaaacguaaacaagaucacauauggagcaugccccaaguauguuaagcaaaacacccugaaguuggcaacagggaugcggaauguaccagagaaacaaacuagaggccuauucggcgcaauagcagguuucauagaaaaugguugggagggaaugauagacgguugguacgguuucaggcaucaaaauucugagggcacaggacaagcagcagaucuuaaaagcacucaagcagccaucgaccaaaucaaugggaaauugaacaggguaaucgagaagacgaacgagaaauuccaucaaaucgaaaaggaauucucagaaguagaagggagaauucaggaccucgagaaauacguugaagacacuaaaauagaucucuggucuuacaaugcggagcuucuugucgcucuggagaaucaacauacaauugaccugacugacucggaaaugaacaagcuguuugaaaaaacaaggaggcaacugagggaaaaugcugaagacaugggcaaugguugcuucaaaauauaccacaaaugugacaacgcuugcauagagucaaucagaaaugggacuuaugaccaugauguauacagagacgaagcauuaaacaaccgguuucagaucaaagguguugaacugaagucuggauacaaagacuggauccuguggauuuccuuugccauaucaugcuuuuugcuuuguguuguuuugcugggguucaucaugugggccugccagagaggcaacauuaggugcaacauuugcauuuga

SEQ ID NO: 32936 - RNA, 1689 nt, Artificial Sequence; identical to SEQ ID NO: 32854
  hemagglutinin__InfluenzaA__ACI26274

SEQ ID NO: 32937 - RNA, 1698 nt, Artificial Sequence
  hemagglutinin__InfluenzaA__ACI26307
augaagacuaucauugcuuugagcuacauucuaugucugguuuuuacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccgguuacggacaaugaccaaaucuuccuguaugcucaaucaggaagaaucacagucucuaccaaaagaagccaacaaacuguaaucccgaauaucggaucuagacccagaguaaggaauagccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaacggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32938 - RNA, 1701 nt, Artificial Sequence
  hemagglutinin__InfluenzaA__ACI26362
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauuggcugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32939 - RNA, 1701 nt, Artificial Sequence
  hemagglutinin__InfluenzaA__ACI26373
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaccagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaaaggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32940 - RNA, 1701 nt, Artificial Sequence; identical to SEQ ID NO: 32806
  hemagglutinin__InfluenzaA__ACI26395

SEQ ID NO: 32941 - RNA, 1701 nt, Artificial Sequence
  hemagglutinin__InfluenzaA__ACI26406
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaacacccagcauugaacgugacuaugccaaacaaugaaaaauuugacaaauuguauauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32942 - RNA, 1701 nt, Artificial Sequence
  hemagglutinin__InfluenzaA__ACI26417
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguauauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaaugggagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32943 - RNA, 1701 nt, Artificial Sequence
  hemagglutinin__InfluenzaA__ACI26428
augaagacuaucauugcuuugagcuacauucuaugucugguuuucgcccaaaaacuucccggaaaugacaacagcacggcaacgcugugccuugggcaccaugcaguaccaaacggaacgauagugaaaacaaucacgaaugaccaaauugaaguuacuaaugcuacugagcugguucagauuuccucaacagguggaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugauguaccggauuaugccucccuuaggucacuaguugccucauccggcacacuggaguuuaacaaugaaagcuucaauuggacuggagucacucaaaauggaacaagcucuucuugcaaaaggagaucuaauaacaguuucuuuaguagauugaauugguugacccacuuaaaauucaaauacccagcauugaacgugacuaugccaaacaaugaaaaauuugacaaauuguacauuugggggguucaccacccgguuacggacaaugaccaaaucagacuauaugcucaagcuucaggaagaaucacagucucuaccaaaagaagccaacaaacuguaaucccgaauaucggauauagacccaggguaagggauauccccagcagaauaagcaucuauuggacaauaguaaaaccgggagacauacuuuugauuaacagcacagggaaucuaauugcuccucgggguuacuucaaaauacgaagugggaaaagcucaauaaugagaucagaugcacccauuggcaaaugcaauucugaaugcaucacuccaaauggaagcauucccaaugacaaaccauuucaaaauguaaacaggaucacauauggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucaaccaaaucaaugggaaacugaauagguugaucgggaaaaccaacgagaaauuccaucagauugaaaaagaauucucagaaguagaagggagaauucaggaccucgagaaauauguugaggacacuaaaauagaucucuggucauacaacgcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagaugaagcauuaaacaaccgguuccagaucaaagguguugagcugaagucaggauacaaagauuggauccuauggauuuccuuugccauaucauguuuuuugcuuuguguuguuuuguugggguucaucaugugggccugccaaaaaggcaacauuaggugcaacauuugcauuuga

SEQ ID NO: 32944 - RNA, 1698 nt, Artificial Sequence
  hemagglutinin__InfluenzaA__ACI26439
augaaaguaaaacuacugguccuauuaugcacauuuacagcuacauaugcagacacaauauguauaggcuaccaugccaacaacucaaccgacacuguugacacaguacuugaaaagaaugugacagugacacacucuguaaaccugcuugaggacagccacaauggaaaauuaugucuauuaaaaggaauagccccacuacaauuggguaauugcagcguugccgguuggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacgggaaagaaugguuuguacccaaaccugagcaaguccuaugcaaacaacaaagagaaagaaguccuuguacuaugggguguucaucacccgccaaacauagguaaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuucagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaauucuguaauugagaagaugaacacucaguucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguacgagaaaguaaaaagccaauuaaagaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32945 - RNA, 1698 nt, Artificial Sequence
  hemagglutinin__InfluenzaA__ACI26450
augaaaguaaaacuacugguccuauuaugcacauuuacagcuacauaugcagacacaauauguauaggcuaccaugccaacaacucaaccgacacuguugacacaguacuugaaaagaaugugacagugacacacucuguaaaccugcuugaggacagccacaauggaaaauuaugucuauuaaaaggaauagccccacuacaauuggguaauugcagcguugccgguuggaucuuaggaaacccagaaugcgaauuacugauuuccaaggagucaugguccuacauuguagaaaaaccaaauccugagaauggaacauguuacccagggcauuucgccgacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacgggaaagaaugguuuguacccaaaccugagcaaguccuaugcaaacaacaaagagaaagaaguccuuguacuaugggguguucaucacccgccaaacauagguaaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuucagaauguacacccagucacaauaggagaauguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaccagaaugagcaaggaucuggcuaugcugcagaucaaaaaagcacacaaaaugccauuaaugggauuacaaacaaggugaauucuguaauugagaagaugaacacucaguucacagcugugggcaaagaauucaacaaauuggaaagaaggauggaaaacuuaaauaaaaaaguugaugacggguuuauagacguuuggacauauaaugcagaacuguugguucuacuggaaaaugaaaggacuuuggauuuccaugacuccaaugugaagaauuuguaugagaaaguaaaaagccaauuaaagaauaaugccaaagaaauaggaaauggguguuuugaauuuuaucacaaguguaacgaugaaugcauggagaguguaaaaaauggaacuuaugacuauccaaaauauuccgaagaaucaaaguuaagcagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32946 - RNA, 1701 nt, Artificial Sequence
  hemagglutinin__InfluenzaA__ACI26461
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucgacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccggguacggacaaugaccaaaucuucccguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaacggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacaauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32947 - RNA, 1698 nt, Artificial Sequence
  hemagglutinin__InfluenzaA__ACI26472
augaagacuaucauugcuuugagcuacauucuaugucugguuuucacucaaaaacuucccggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguacauuugggggguucaccacccgguuacggacaaugaccaaaucuuccuguaugcucaaucaggaagaaucacagucucuaccaaaagaagccaacaaacuguaaucccgaauaucggauauagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaacggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32948 - RNA, 1701 nt, Artificial Sequence
  hemagglutinin__InfluenzaA__ACI26483
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaccagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32949 - RNA, 1701 nt, Artificial Sequence
  hemagglutinin__InfluenzaA__ACI26505
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaccagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaagaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32950 - RNA, 1701 nt, Artificial Sequence
  hemagglutinin__InfluenzaA__ACI26516
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucgcuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauuaaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32951 - RNA, 1701 nt, Artificial Sequence
  hemagglutinin__InfluenzaA__ACI26527
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaccagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauugggcuggagucacucaaaacggaacaagcucugcuugcauaaggaaaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32952 - RNA, 1701 nt, Artificial Sequence
  hemagglutinin__InfluenzaA__ACI26538
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagauaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagagaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 32953 - RNA, 1701 nt, Artificial Sequence
  hemagglutinin__InfluenzaA__ACI26549
augaagacuaucauugcuuugagcuacauuuucugucugguuuucgcccaaaaacuucccggaaaugacaacagcacagcaacgcugugccugggacaucaugcagugccaaacggaacgcuagugaaaacaaucacgaaugaucagauugaagugacuaaugcuacugagcugguucagaguuccucaacagguagaauaugcgacaguccucaccgaauccuugauggaaaaaacugcacacugauagaugcucuauugggagacccucauugugauggcuuccaaaaugagaaaugggaccuuuuuguugaacgcagcaaggcuuacagcaacuguuacccuuaugaugugccggauuaugccucccuuaggucacuaguugccucaucaggcacccuggaguuuaucaaugaagacuucaauuggacuggagucacucagagugggggaagcuauucuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaacuauauguucgagcaucagggagagucacagucucuaccaagagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgcacugggaaaagcucaauaaugaggucagaugcaccuauuggcaccugcaguucugaaugcaucacuccaaauggaagcauucccaaugacaaacccuuucaaaauguaaacaagaucacauauggggcaugucccagauauguuaagcaaaacacucugaaauuggcaacagggaugcggaauguaccagagaaacaaacuagaggcauauucggcgcaauagcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgaggaauauguugaagacacuaaaauagaucucuggucuuacaacgcggagcuucuugucgcccuggagaaccaacauacaauugaucugacugacucagaaaugaacaaacuguuugaaaaaacaaggaagcaacugagggaaaaugcugaggacaugggcaaugguugcuucaagauauaccacaaaugugacaaugcuugcauagggucaaucagaaauggaacuuaugaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 32954 - RNA, 1701 nt, Artificial Sequence
  hemagglutinin__InfluenzaA__ACI26560
augaagaccaucauugcuuugagcuacauuuucugucugguuuucgcccaaaaacuucccggaaaugacaacagcacagcaacgcugugccuaggacaucaugcagugccaaacggaacgcuagugaaaacaaucacgaaugaccaaauugaagugacuaaugcuacugagcugguucagaguuccucaacaggucgaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagauuucaauuggacuggagucgcucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgaucacggacagagaacaaaccaaccuauauguucgagcaucagggagagucacagucucuaccaaaagaagccagcaaacuguaaucccgaauaucgggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacggaaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuaugaccaugauguauacagagacgaagcauuaaacaaccgguuccagaucaaagguguugagcuaaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 32955 - RNA, 1701 nt, Artificial Sequence
  hemagglutinin__InfluenzaA__ACI26571
augaagaccaucauugcuuugagcuacauuuucugucugguuuucgcccaaaaacuucccggaaaugacaacagcacagcaacgcugugccuaggacaucaugcagugccaaacggaacgcuagugaaaacaaucacgaaugaccaaauugaagugacuaaugcuacugagcugguucagaguuccucaacaggucgaauaugcgacaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagauuucaauuggacuggagucgcucagagugggggaagcuaugcuugcaaaaggggaucuguuaacaguuucuucaguagauugaauugguugcacgaaucagaauacaaauauccagcgcugaacgugacuaugccaaacaauggcaaauuugacaaauuguacauuugggggguucaccacccgagcacggacagagaacaaaccaaacuauauguucgagcaucagggagagucacagucucuaccaaaagaagccagcaaacuguaaucccgaauauugggucuagacccuggguaaggggucuguccaguagaauaagcaucuauuggacaauaguaaaaccgggagacauacuguugauuaauagcaccgggaaccuaauugcuccucgggguuacuucaaaauacgaacuggaaaaagcucaauaaugaggucagaugcacccauuggcaccugcaguucugaaugcaucacuccaaauggaagcauucccaaugacaaacccuuucaaaauguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuugucgcucuggagaaccaacauacaauugaucugacugacucagaaaugaacaaacuguuugaaaaaacaaggaagcaacugagggaaaaugcugaggacaugggcaaugguugcuucaagauauaccacaaaugugacaaugccugcauagggucaaucagaaauggaacuuauaaccaugauguauacagagacgaagcauuaaacaaccgguuccagaucaaagguguugagcugaagucaggauacaaagacuggauccuauggauuuccuuugccauaucaugcuuuuugcuuuguguuguuuugcugggguucaucaugugggccugccaaaaaggcaacauuaggugcaacauuugcauuuga

SEQ ID NO: 32956 - RNA, 1701 nt, Artificial Sequence
  hemagglutinin__InfluenzaA__ACI26593
augaagacuaucauugcuuugagcuacauuuuaugucugguuuucgcccaaaaacuucccggaaaugacaacagcacagcaacgcugugccugggacaucaugcagugccaaacggaacgcuagugaaaacaaucacgaaugaucaaauugaagugacuaaugcuacugagcugguucagaguuccucaacagguagaauaugugacaguccucaccgaauccuugauggaaaaaauugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaccaaugaagacuucaauuggacuggagucgcucagaguggggaaagcuaugcuugcaaaaggggaucuguuaaaaguuucuuuaguagauugaauugguugcacaaaucagauuacaaauauccagcgcugaacgugacuaugccaaacaauggcaaauuugacaaauuguacauuugggggguucaccacccgagcacggacagagaacaaaccagccuauauguucgagcaucagggagagucacagucuccaccaaaagaagccaacaaacugugaucccgaauaucgggucuagacccuggguaaggggucuguccaguagaauaagcaucuauuggacaauagugaaaccgggagacauacuuuugauuaauagcaccgggaaccuaauugcuccucgggguuacuucaaaauacgaacugggaaaagcucgauaaugagaucagaugcacccauuggcaccugcaguucugaaugcaucacuccaaauggaagcauccccaaugacaaaccuuuucaaaacguaaacaggaucacauauggggcaugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccaucaaaucgaaaaggaauucucagaaguagaagggagaauucaggaccucgagaaauauguugaagacacuaaaauagaucucuggucuuacaacgcggagcuucuuguugcccuggagaaccaacauacaauugaucugacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 32957 - RNA, 1698 nt, Artificial Sequence
  hemagglutinin__InfluenzaA__ACI32715
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggauccuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaccauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggauaugcugcagaucaaaaaagcacacaaaaugccauuaacgggauuacaaacaaggugaauacuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuuacaguguagaauaugcaucuaa

SEQ ID NO: 32958 - RNA, 1698 nt, Artificial Sequence
  hemagglutinin__InfluenzaA__ACI32716
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggagucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggauaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaauccaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuuacaguguacaauaugcaucuaa

SEQ ID NO: 32959 - RNA, 1698 nt, Artificial Sequence
  hemagglutinin__InfluenzaA__ACI32717
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucacuucaaaugcaccaauggaugaaugugaugcgaagugucaaacaccucaaggagcuaugaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaauccaaguuaaacagggagaaaauugauggagugaaauuggaaucaaugggagucuaucagauucuggcgaucuacucaacagucgccaguucccugguucuuuuggucucccugggggcaaucaacuucuggauguguuccaaugggucuuugcaguguaaaauaugcaucuaa

SEQ ID NO: 32960 - RNA, 1698 nt, Artificial Sequence
  hemagglutinin__InfluenzaA__ACI32718
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccauuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccgcaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagucuuccuuuccagaauguacacccagucacaauaggggaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggauuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaguaggaaacggguguuuugaauucuaucacaaauguaacgaugaaugcauggagagugugaaaaauggaacuuaugacuauccaaaauauuccgaagaauccaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguacaauaugcaucuaa

SEQ ID NO: 32961 - RNA, 1698 nt, Artificial Sequence
  hemagglutinin__InfluenzaA__ACI32719
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaagagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucacuucaaaugcaccaauggaugaaugugaugcgaagugucaaacaccucaaggagcuauaaacagcagucuuccuuuccagaauguacacccagucacuauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaauguaacgaugaaugcauggagagugugaaaaauggaacuuaugacuauccaaaauauuccgaagaauccaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguacaauaugcaucuaa

SEQ ID NO: 32962 - RNA, 1698 nt, Artificial Sequence
  hemagglutinin__InfluenzaA__ACI32720
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagggaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaauccaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguacgauaugcaucuaa

SEQ ID NO: 32963 - RNA, 1698 nt, Artificial Sequence
  hemagglutinin__InfluenzaA__ACI32721
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucagcuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaccaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggaaagaaggauggaaaacuuaaauaagaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32964 - RNA, 1698 nt, Artificial Sequence
  hemagglutinin__InfluenzaA__ACI32722
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaaugggaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaagaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaaucuuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaauccaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguacaauaugcaucuaa

SEQ ID NO: 32965 - RNA, 1698 nt, Artificial Sequence
  hemagglutinin__InfluenzaA__ACI32723
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaagaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaaucuuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcuucuaa

SEQ ID NO: 32966 - RNA, 1698 nt, Artificial Sequence
  hemagglutinin__InfluenzaA__ACI32724
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcugaaacccggggauacaauaaucuuugaggcaaauggaaaucuaauagcgccaagguuugcuuucgcacugaguagaggcuuuggaucaggaaucaucaccucaaaugcaccaauggaugaaugugaugcgaagugucaaacaccucaaggagcuauaaacagcagccuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaagaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguaaaauaugcaucuaa

SEQ ID NO: 32967 - RNA, 1698 nt, Artificial Sequence
  hemagglutinin__InfluenzaA__ACI32725
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucacuucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuagagagaaggauggaaaauuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32968 - RNA, 1698 nt, Artificial Sequence
  hemagglutinin__InfluenzaA__ACI32726
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggauccuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaaaaaugguuuguacccaaaccugagcaaguccuaugcaaacaacaaagagaaagaaguccuuguacuaugggguguucaucacccgcccaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucacuucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagaaaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaauccaaguuaaacagggagaaaauugauggagugaaauuggaaucaaugggaaucuaucagauucuggcgaucuacucaacagucaccaguucccugguucuuuuggucucccugggggcaaucagcuucuggauguguuccaaugggucuuugcaguguagaauaugcaucuaa

SEQ ID NO: 32969 - RNA, 1698 nt, Artificial Sequence
  hemagglutinin__InfluenzaA__ACI32727
augaaaguaaaacuacugguucuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaauaucuucauuugagagguucgaaauauuccccaaagagagcucauggcccaaccacaccguaaccggaguaucagcaucaugcucccauaacgggaaaagcaguuuuuacagaaauuugcuauggcugacggggaagaauggcuuguacccaaaccugagcaaguccuaugcaaacaacaaagagaaagaaguccuuguacuaugggguguucaucacccgcccaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucacuucaaaugcaccaauggaugaaugugaugcgaagugucaaacaccucaaggagcuauaaacagcagucuuccuuuccagaauguacacccagucacaauaggagaguguccaaaguaugucaggagugcaaaauuaaggauggcuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucagcaaauuggagagaaggauggaaaacuuaaauaaaaaaguugaugauggguuucuagacauuuggacauauaaugcagaauuguugguucuacuggaaaaugaaaggacuuuggauuuccaugacuccaacgugaagaaucuguaugagaaagugaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguuaaacagggagaaaauugauggagugaaauuggaaucaaugggaguauaucagauucuggcgaucuacucaacagucgccaguucccugguucuuuuggucacccugggggcaaucagcuucuggauguguuccaaugggucuuugcaguguacaauaugcaucuaa

SEQ ID NO: 32970 - RNA, 1698 nt, Artificial Sequence
  hemagglutinin__InfluenzaA__ACI32729
augaaaguaaaacuacugguucuguuauguacauuuacagcuacauaugcagacacaauauguauaggcuaccaugccaacaacucgaccgacacuguugacacaguacuugagaaaaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauucccaaggaaucaugguccuacauuguagaaacaccaaauccugaaaauggaacauguuacccaggguauuucgccgacuaugaggagcugagggagcaauugaguucaguaucuucauuugagagguucgaaauauuccccaaagaaagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgcccaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagauuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggguuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32971 - RNA, 1698 nt, Artificial Sequence; identical to SEQ ID NO: 32970
  hemagglutinin__InfluenzaA__ACI32730

SEQ ID NO: 32972 - RNA, 1698 nt, Artificial Sequence
  hemagglutinin__InfluenzaA__ACI32731
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccaaacauaggugaccaaaaggcccucuaucauacagaaaaugcuuaugucucuguagugucuucacauuauagcagaaaauucaacccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugcugguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugaaaaaaugaacacucaauucacagcagugggcaaagaauucaacaaauuggaaagaaggauggaaaacuuaaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguaaaauaugcaucuaa

SEQ ID NO: 32973 - RNA, 1698 nt, Artificial Sequence
  hemagglutinin__InfluenzaA__ACI32732
augaaaguaaaacuacugguucuguuauguacauuuacagcuacauaugcagacacaauauguauaggcuaucaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagaaagcucauggcccaaccacaccguaaccggaguaucagcaucaugcucccauaacgggaaaagcaguuuuuacagaaauuugcuauggcugacggggaagaauggcuuguacccaaaccugagcaaguccuaugcaaacaacaaagagaaagaaguccuuguacugugggguguucaucacccgccuaacauaggggaccaaagggcccuauaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaauccaaguugaacagggagaaaauugauggagugaaauuggaauccaugggagucuaucagauucuggcgaucuacucaacagucgccaguucccugguucuuuuggucucccugggggcaaucagcuucuggauguguuccaaugggucuuugcaguguacaauaugcaucuaa

SEQ ID NO: 32974 - RNA, 1698 nt, Artificial Sequence
  hemagglutinin__InfluenzaA__ACI32733
augaaaguaaaacuacugguccuguuaugcacauuuacagcuacauaugcagacacaauauguauaggcuaccaugccaacaacucaaccgacacuguugacacaguacuugaaaagaaugugacagugacacacucugucaaccugcuugaggacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccaaacauaggugaccaaaaggcccucuaucauacagaaaaugcuuaugucucuguagugucuucacauuauagcagaaaauucaacucagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugcugguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugaaaaaaugaacacucaauucacagcagugggcaaagaauucaacaaauuggaaagaaggauggaaaacuuaaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugccaaagaaauaggaaauggguguuuugaauucuaccacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguacaauaugcaucuaa

SEQ ID NO: 32975 - RNA, 1698 nt, Artificial Sequence
  hemagglutinin__InfluenzaA__ACI32734
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaaaagaaagaaguccuuguacugugggguguucaucacccgccuaacauaggggaccaaaaggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuuuggaucaggaaucaucaccucaaaugcaccgauggaugaaugugaugcgaagugucaaacaccucagggagcuauaaacagcagucuuccuuuccagaauguacacccagucacaauaggagaguguccaaaguaugucaggagugcaaaauuaagaaugguuacaggacuaaggaacaucccauccauucaauccagagguuuguuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguacaauaugcaucuaa

SEQ ID NO: 32976 - RNA, 1698 nt, Artificial Sequence
  hemagglutinin__InfluenzaA__ACI32736
augaaaguaaaacuacugguccuguuaugcacauuuacagcuacauaugcugacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuccccaaagaaagcucauggcccaaccacaccgcaaccggaguaucagcaucaugcucccauaaugggaaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaccaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugaacccggggauacaauaauauuugaggcaaauggaaaucuaauagcgccaagauaugcuuucgcacugaguagaggcuuuggaucaggaaucaucaacucaaaugcaccaauggaugaaugugaugcgaagugccaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaggaaucuguaugagaaaguaaaaagccaauuaaagaauaaugccaaagaaauaggaaauggguguuuugaauucuaucacaaguguaacgaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32977 - RNA, 1698 nt, Artificial Sequence
  hemagglutinin__InfluenzaA__ACI32737
augaaaguaaaacuacugguucuguuauguacauuuacagcuacauaugcagacacaauauguauaggcuaccaugccaacaauucaaccgacacuguugacacaguacuugagaagaaugugacagugacacacucugucaaccuacuugagaacagucacaauggaaaacuaugucuacuaaaaggaauagccccacuacaauuggguaauugcagcguugccggauggaucuuaggaaacccagaaugcgaauuacugauucccaaggaaucaugguccuacauuguggaaauaccaaauccugagaauggaacauguuacccaggguauuucgccgacuaugaggagcugagggagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguacccaaaccugagcaaguccuaugcaaacaacaaagagaaagaaguccuuguacuaugggguguccaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuggaacccggggauacaauaauauuugaggcaaauggaaaucuaauagcgccaagguuugcuuucgcacugaguagaggcuugggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggaccuauaaugcagaauuguugguucuacuggaaaaugaaaggacuuuggauuuccaugacuccaacgugaagaaucuguaugagaaaguaaaaagccaauuaaggaauaaugccaaagaaauaggaaacggguguuuugaauucuaucacaaguguaacgaugaaugcauggagagugugaaaaauggaacuuaugacuauccaaaauauuccgaagaauccaaguuaaacagggagaaaauugauggagugaaauuagaaucaaugggagucuaucagauucuggcgaucuacucaacagucgccaguucccugguucuuuuggucucccugggggcaaucagcuucuggauguguuccaaugggucuuugcaguguagaauaugcaucuaa

SEQ ID NO: 32978 - RNA, 1698 nt, Artificial Sequence
  hemagglutinin__InfluenzaA__ACI32739
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacuaugucuacuaaaaggaauagccccccuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggagcuaagggagcaauugaguucaguaucuucauuugagagauucgaaauauuccccaaagaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauagggaaccaaaggacucucuaucauacagaaaaugcuuaugucucuguagugucuucacauuauagcagaagauucaccccagaaauaaccaaaaggcccaaaguaagagaucaggaagggagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaagaauggaaaacuuaaauaaaaaaguugaugauggauuucuagacauuuggacauauaaugcagaauuguugguucuacuggaaaaugaaaggacuuuggauuuccacgacuccaaugugaagaaucuguaugagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaauccaaguuaaacagggaaaaaauugauggagugaaauuggaaucaaugggagucuaucagauucuggcgaucuacucaacugucgccaguucccugguucuuuuggucucccugggggcaaucagcuucuggauguguuccaaugggucuuugcaguguaaaauaugcaucuga

SEQ ID NO: 32979 - RNA, 1698 nt, Artificial Sequence
  hemagglutinin__InfluenzaA__ACI32740
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaacacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaaucaaaguuaaacagggaaaaaauugauggagugaaauuggacucaaugggggucuaucagauucuggcaaucuacucaacugucgccaguucccugguucuuuuggucucccugggggcaaucagcuucuggaugugucccaaugggucuuugcaguguacaauaugcaucuga

SEQ ID NO: 32980 - RNA, 1698 nt, Artificial Sequence
  hemagglutinin__InfluenzaA__ACI32741
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuccccaaagaaagcucauggcccaaacacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagagguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaauccaaguuaaacagggaaaaaauugauggagugaaauuggacucaaugggggucuaucagauucuggcgaucuacucaacugucgccaguucccugguucuuuuggucucccugggggcaaucagcuucuggaugugucccaaugggucuuugcaguguaaaauaugcaucuga

SEQ ID NO: 32981 - RNA, 1698 nt, Artificial Sequence
  hemagglutinin__InfluenzaA__ACI32742
augaaaguaaaacuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggaacauguuacccaggguauuucgccgacuaugaggaacugagggagcaauugaguucaguaucuucauuugagagguucgaaauauuccccaaagagagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauaggggaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaaaaauggaacuuaugacuauccaaaauauuccgaagaauccaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguaaaauaugcaucuga

SEQ ID NO: 32982 - RNA, 1698 nt, Artificial Sequence
  hemagglutinin__InfluenzaA__ACI32743
augaaaguaaaauuacugauccuguuauguacauuuacagcuacauaugcagacacaauauguauaggcuaccaugccaacaacucaaccgacacuguugacacaguacuugagaagaaugugacagugacacacucugucaaccuacuugaggacagucacaauggaaaacugugccuacuaaaaggaauagccccccuacaauuggguaauugcagcguugccggauggaucuuaggaaacccagaaugcgaauuacugauuuccaaggaaucaugguccuacauuguagaaacaccaaauccugagaauggagcauguuacccaggguauuucgccgacuaugaggagcuaagggagcaauugaguucaguaucuucauuugagagauucgaaauauuucccaaaaaaagcucauggcccaaccacaccguaaccggaguaucagcaucaugcucccauaaugggaaaagcaguuuuuacagaaauuugcuauggcugacggggaagaaugguuuguacccaaaccugagcaaguccuaugcaaacaacaaagagaaagaaguccuuauacuaugggguguucaucacccgccuaacauagggaaccaaaggacccucuaucacacagaaaaugcuuaugucucuguagugucuucacauuauagcagaagauucaccccagaaauaaccaaaaggcccaaaguaagagaucaggaaggaagaaucaacuacuacuggacucugcuggaacccggggauacaauaauauuugaggcaaauggaaaucuaauagcgccaugguaugcuuucgcacugaguagaggcuuuggaucaggaaucaucaccucaaaugcaccaauggaugaaugugaugcgaagugucaaacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugggugguaugguuaucaucaucagaaugagcaaggaucuggcuaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaagguugaugauggguuucuagacauuuggacauauaaugcagaauuguugguucuacuggaaaaugaaaggacuuuggauuuccacgacuccaaugugaagaaucuguacgagaaaguaaaaagccaauuaaagaauaaugccaaagaaauaggaaauggguguuuugaauucuaucacaaguguaacaaugaaugcauggagagugugaagaauggaacuuaugacuauccaaaauauuccgaagaauccaaguuaaacagggaaaaaauugauggagugaaauuggacucaaugggggucuaucagauucuggcgaucuacucaacugucgccaguucccugguucuuuuggucucccugggggcaaucagcuucuggauguguuccaaugggucuuugcaguguagaauaugcaucuga

SEQ ID NO: 32983 - RNA, 1701 nt, Artificial Sequence
  hemagglutinin__InfluenzaA__ACJ09818
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaguugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauauccagcauugaacgugacuaugccaaacaaugaaaaauuugacaaauuguacauuugggggguucaccacccggguacagacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccaugucauguuuuuugcuuuguguugcuuuguugggguucaucaugugggccugccaaaaaggcaacauuaggugcaacauuugcauuuga

SEQ ID NO: 32984 - RNA, 1683 nt, Artificial Sequence
  hemagglutinin__InfluenzaA__ACJ67533
auggaaacaauaucacuaauaacuauacuacuaguaguaacagcaagcaaugcagauaaaaucugcaucggccaccagucaacaaacuccacagaaacuguggacacgcuaacagaaaccaauguuccuguuacacaugccaaagaauuacuccacacagagcacaauggaaugcugugugcaacaagucugggacauccccucauucuagacacaugcacuauugaaggacuagucuauggcaacccuucuugugaccugcuguuagaaggaagagaaugguccuacaucgucgaaagaucaucagcuguaaauggaacguguuacccugggaauguagaaaaccuagaggaacucaggacacuuuuuaguuccgcuaguuccuaccaaagaauccaaaucuucccagacacaaccuggaaugugacuuacacuggaacaagcagagcauguucagguucauucuacaggagcaugagauggcugacucaaaagagcgguuuuuacccuguucaagacgcccaauacacaaauaacaggggaaagagcauucuuuucguguggggcauacaucacccacccaccuaugccgaacaaacaaauuuguacauaagaaacgacacaacaacaagcgugacaacagaagauuugaauaggaccuucaaaccagugauagggccaaggccccuugucaauggucugcagggaagaauugauuauuauuggucgguacuaaaaccaggccaaacauugcgaguaagauccaaugggaaucuaaucgcuccaugguauggacacguucuuucaggagggagccauggaagaauccugaagacugauuuaaaaagugguaguuguguagugcaaugucagacugaaaaagguggcuuaaacaguacauugccauuccacaauaucaguaaauaugcauuuggaaccugccccaaauauguaagaguuaauagucucaagcuggcagucggucugaggaacgugccugcuagaucaaguagaggacuauuuggagccauagcuggauucauagaaggagguuggccaggacuagucgcuggcugguaugguuuccagcauucaaaugaucaagggguugguauggcugcagauagggauucaacucaaaaggcaauugauaaaauaacauccaaggugaauaauauagucgacaagaugaacaagcaauaugaaauaauugaucaugaauucagugagguugaaacuagacucaauaugaucaauaauaagauugaugaccaaauacaagacguaugggcauauaaugcagaauugcuaguacuacuugaaaaucagaaaacacucgaugagcaugaugcgaacgugaacaaucuauauaacaaggugaagagggcacugggcuccaaugcuauggaagaugggaaaggcuguuucgagcuauaccauaaaugugaugaucagugcauggaaacaauucggaacgggacuuauaauaggagaaaguauagagaggaaucaagacuagagaggcagaaaauagaggggguuaagcuggaaucugagagaacuuacaaaauccucaccauuuauucgacugucgccucaucucuugugcuugcaaugggguuugcugccuuccuguucugggccauguccaaugggucuugcagaugcaacauuuguauauaa

SEQ ID NO: 32985 - RNA, 1704 nt, Artificial Sequence
  hemagglutinin__InfluenzaA__ACJ68607
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagauauacuggaaaagacacacaacgggaagcucugcgaucuagauggagugaagccucugauuuuaggagauuguaguguagcuggauggcuccucggaaacccgaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcuuagaaauaguccccuaagagaaagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagauguauggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaaugcauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 32986 - RNA, 1704 nt, Artificial Sequence
  hemagglutinin__InfluenzaA__ACJ68609
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccuuggaaacccaaugugugacgaauucaucaaugugccggaauggucuuacauaguggagaaggccaacccagccaaugaccucuguuacccaggaaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauauccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagaaagaagaagaaaaagaggacuauuuggagcuauagcaggguuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaagaagagaggaaauaaguggaguaaaauuggaaucaauaggaacuuaccaaauacugucaauuuauucaacaguugcgaguucucuagcacuggcaaucaugguggcuggucuaucuuuguggaugugcuccaaugggucguuacaaugcagaauuugcauuuaa

SEQ ID NO: 32987 - RNA, 1704 nt, Artificial Sequence
  hemagglutinin__InfluenzaA__ACJ68610
auggagaaaauagugcuuuuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggauuucuucuggacaauuuuaaaaccaaaugaugcaaucaacuucgagaguaauggaaauuucauugcuccagaauaugcauacaaaauugucaagaaaggggacucagcaauuauaaaaagugaaguggaauaugguaacugcaacaccaagugucaaacuccaauaggggcgauaaacucuaguaugccauuccacaacauacacccucucaccaucggggaaugcccaaaauaugugaaaucaaacaaauuaguccuugcgacugggcucagaaauaguccucuaagagaaagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggaguuaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuucaugacucaaaugucaagaaccucuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgaguucucuagcacuggcaaucaugguggcuggucuaucuuuauggaugugcuccaaugggucguuacaaugcagaauuugcauuuaa

SEQ ID NO: 32988 - RNA, 1704 nt, Artificial Sequence
  hemagglutinin__InfluenzaA__ACJ68611
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagauauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaucauuuugagaaaauucagaucauccccaaaaguucuugguccgaucaugaagccucauugggggugagcucagcauguccauaccagggaaugcccuccuuuuucagaaaugugguauggcuuaucaaaaagaacaauacauacccaacaauaaagagaagcuacaauaauaccaaccaggaagaucuuuugauacugugggggauucaucauucuaaugaugcggcagagcagacaaagcucuaucaaaacccaaccacuuauauuuccguugggacgucaacacuaaaccagagauugguaccaaaaauagcuacuagauccaaaguaaacgggcaaaguggaaggauggauuucuucuggacaauuuuaaaaccaaaugaugcaaucaacuucgagaguaauggaaauuucauugcuccagaauaugcauacaaaauugucaagaaaggggacucagcaauuaugaaaagugaagugggauaugguaacugcaacaccaagugucaaacuccaauaggggcaauaaacucuaguaugccauuccacaacauacacccucucaccaucggggaaugccccaaauaugugaaaucaaacaaauuaguccuugcgacugggcucagaaauaguccucuaagagagagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugaugaugaaugcauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguugcgaguucccuagcacuggcaaucaugguggcuggucuaucuuuauggaugugcuccaaugggucguuacaaugcagaauuugcauuuaa

SEQ ID NO: 32989 - RNA, 1704 nt, Artificial Sequence
  hemagglutinin__InfluenzaA__ACJ68612
auggagaaaauagugcuucuucuugcaauagucagccuuguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagauggagugaagccucugauuuuaagagauuguaguguagcuggauggcuccucggaaacccaaugugugacgaauucaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuuggcccgaucaugaagccucaucaggggugagcucagcauguccauaccagggaacgcccuccuuuuucagaaaugugguauggcuuaucaaaaagaacaauacauacccaacaauaaagagaagcuacaauaauaccaaccaggaagaucuuuugauacugugggggauucaucauucuaauaaugcggcagagcagacaaagcucuaucaaaacccaaccaccuauauuuccguugggacaucaacacuaaaccugagauugguaccaaaaauagcuacuagauccaaaguaaacgggcaaaguggaaggauggauuucuucuggacaauuuuaaaaccgaaugaugcaaucaacuucgagaguaauggaaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugccccaaauaugugaaaucaaacaaauuaguccuugcgacugggcucagaaauaguccucuaagagagagaagaagaaaaagaggacuauuuggagcuauagcagguuuuauagagggaggauggcagggaaugguagaugguugguauggguaccaccauagcaaugagcaggggaguggguacgcugcagacaaagaauccacucaaaaggcaauagauggagucaccaauaaggucaacucgaucauugacaaaaugaacacucaguuugaggccguuggaagggaauuuaauaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggaacuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggagcuuaccaaauacugucaauuuauucaacaguugcgaguucucuagcacuggcaaucaugguggcuggucuaucuuuauggaugugcuccaaugggucguuacaaugcagaauuugcauuuaa

SEQ ID NO: 32990 - RNA, 1704 nt, Artificial Sequence
  hemagglutinin__InfluenzaA__ACJ68613
auggagaaaauagugcuuuuccuugcaauagucagccauguuaaaagugaucagauuugcauugguuaccaugcaaacaacucgacagagcagguugacacaauaauggaaaagaacguuacuguuacacaugcccaagacauacuggaaaagacacacaacgggaagcucugcgaucuagguggagugaagccucugauuuuaagagauuguaguguagcuggauggcuccucggaaacccaaugugugacgaauuuaucaaugugccggaauggucuuacauaguggagaaggccaacccagccaaugaccucuguuacccagggaauuucaacgacuaugaagaacugaaacaccuauugagcagaauaaaccauuuugagaaaauucagaucauccccaaaaguucuugguccgaucaugaagccucaucaggggugagcucaguauguccauaccagggaacgcccuccuuuuucagaaaugugguauggcuuaucaaaaagaacaauacauacccaacaauaaagaaaagcuacaauaauaccaaccaggaagaucuuuugauacugugggggauucaucauucuaaugaugcggcagagcagacaaagcucuaucaaaacccaaccaccuauauuuccguugggacaucaacacuaaaccagagauugguaccaaaaauagcuacuagauccaaaguaaacgggcaaaguggaaggauggauuucuucuggacaauuuuaaaaccgaaugaugcaaucaacuucgagaguaaugggaauuucauugcuccagaauaugcauacaaaauugucaagaaaggggacucagcaauuaugaaaagugaaguggaauaugguaacugcaacaccaagugucaaacuccaauaggggcgauaaacucuaguaugccauuccacaacauacacccucucaccaucggggaaugcccaaaauaugugaaaucaaacaaauuaguccuugcgacugggcucagaaauaguccucuaagagaaagaagaagaaaaagaggacuauuuggagcuauagcagguuuuauagagggaggauggcagggaaugguagaugguugguauggguaccaccauagcaaugagcaggggaguggauaugcugcagacaaagaauccacucaaaaggcaauagauggagucaccaauaaggucaacucgaucauugacaaaaugaacacucaguuugaggccguuggaagggaauuuaacaacuuagaaaggagaauagagaauuuaaacaagaaaauggaagacggauuccuagaugucuggacuuauaaugcugaacuucugguucucauggaaaaugagagaacucuagacuuccaugacucaaaugucaagaaccuuuacgacaagguccgacuacagcuuagggauaaugcaaaggagcuggguaacgguuguuucgaguucuaucacaaaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgaguucucuagcacuggcaaucaugguggcuggucuaucuuuauggaugugcuccaaugggucguuacaaugcagaauuugcauuuaa

SEQ ID NO: 32991 - RNA, 1707 nt, Artificial Sequence
  hemagglutinin__InfluenzaA__ACJ68614
auggagaaaauagugcuucuucuugcaauagucagucuuguuaaaagugaucagauuugcauugguuaccaugcaaacaacucgacagagcagguugacacaauaauggaaaagaacgucacuguuacacacgcccaagacauacuggaaaagacacacaacgggaagcucugcgaucuagauggagugaagccucuaauuuuaagagauuguaguguagcuggauggcuccucgggaacccaaugugugacgaauuccucaaugugccggaauggucuuacauaguggagaagaucaauccagucaaugaccucuguuacccagggaauuucaacgacuaugaagaacugaaacaccuauugagcagaauaaaccauuuugagaaaauucagaucauccccaaaaguucuuggucagaucaugaagccucaucaggggugagcucagcauguccauaccagggaagguccuccuuuuuuagaaaugugguauggcuuaucaaaaagaacaauacauacccaacaauaaagagaaguuacaauaauaccaaccaagaagaucuuuugguacugugggggauucaccauccaaaugaugcggcagagcagacaaggcucuaccaaaacccaaccaccuauauuuccguugggacaucaacacuaaaccagagauugguaccaaaacuagcuacuagauccaagguaaacgggcaaaguggaaggauggaguucuuuuggacaauuuuaaaaccgaaugaugcaauaaacuuugagaguaauggaaauuucauugcuccagaaaaugcauacaaaauugucaagaaaggggacucaacaauuaugaaaagugaauuggaauaugguaacugcaacaccaagugucaaacuccaauaggggcgauaaacucuaguaugccauuccacaacauccacccucucaccaucggggaaugccccaaauaugugaaaucaaacagauuaguccuugcgacugggcucagaaauagcccucaaggagagagaagaaggaaaaagagaggacuauuuggagcuauagcagguuuuauagagggaggauggcagggaaugguagaugguugguauggguaccaccauagcaacgagcgggggaguggguacgcugcagacaaagaauccacucaaaaggcaauagauggagucaccaauaaggucaacucgaucauugacaaaaugaacacucaguuugaggcuguuggaagggaauuuaauaacuuagaaaggagaauagaaaauuuaaacaagaagauggaagacggauuccuagaugucuggacuuauaaugcugaacuucugguucucauggaaaaugagagaacucuagacuuucaugacucaaaugucaagaaccuuuacgacaagguccgacuacagcuuagggauaaugcaaaggagcuugguaacgguuguuucgaguucuaucacagaugugauaaugaauguauggaaaguguaagaaacggaacguaugacuacccgcaguauucagaagaagcaagauuaaaaagagaggaaauaaguggaguaaaauuggaaucaauaggaacuuaccaaauacugucaauuuauucaacaguggcgagcucccuagcacuggcaaucaugguggcuggucuaucuuuauggaugugcuccaauggaucguuacaaugcagaauuugcauuuaa

SEQ ID NO: 32992 - RNA, 1698 nt, Artificial Sequence
  hemagglutinin__InfluenzaA__ACK99007
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaagucuuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32993 - RNA, 1698 nt, Artificial Sequence
  hemagglutinin__InfluenzaA__ACK99008
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaguaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagccgugggcaaagaauucaacaaauuggaaagaaggauggaaaacuugaauaaaaaaguugaugauggguuuauagacaucuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaauggaagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32994 - RNA, 1698 nt, Artificial Sequence
  hemagglutinin__InfluenzaA__ACK99009
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaacauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32995 - RNA, 1698 nt, Artificial Sequence
  hemagglutinin__InfluenzaA__ACK99011
augaaaguaaaacuacugguccuguuaugcacauuuacagcuacauaugcagacacaauauguauaggcuaccaugcuaacaacucgaccgacacuguugacacaguacuugaaaagaaugugacagugacacacucuguaaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32996 - RNA, 1698 nt, Artificial Sequence
  hemagglutinin__InfluenzaA__ACK99012
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuugaucucccugggggcaaucagcuucuggauguguuccaaugggucuuugcaguguagaauaugcaucuaa

SEQ ID NO: 32997 - RNA, 1698 nt, Artificial Sequence
  hemagglutinin__InfluenzaA__ACK99013
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32998 - RNA, 1698 nt, Artificial Sequence
  hemagglutinin__InfluenzaA__ACK99014
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucacacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuauaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 32999 - RNA, 1698 nt, Artificial Sequence; identical to SEQ ID NO: 32997
  hemagglutinin__InfluenzaA__ACK99016

SEQ ID NO: 33000 - RNA, 1698 nt, Artificial Sequence
  hemagglutinin__InfluenzaA__ACK99018
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccaccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33001 - RNA, 1698 nt, Artificial Sequence; identical to SEQ ID NO: 32997
  hemagglutinin__InfluenzaA__ACK99023

SEQ ID NO: 33002 - RNA, 1698 nt, Artificial Sequence
  hemagglutinin__InfluenzaA__ACK99026
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccaaucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaacggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33003 - RNA, 1698 nt, Artificial Sequence
  hemagglutinin__InfluenzaA__ACK99027
augaaaguaaaacuacugguccuguuaugcacauuuacagcuacauaugcagacacaauauguauaggcuaccaugccaacaacucaaccgacacuguugacacaguacuugagaagaaugugacagugacacacucugucaaccugcuugaggacagucacaauggaaaauuaugucuauuaaaaggaauagccccacuacaauuggguaauugcagcguugccggauggaucuuaggaaacccagaaugcgaauuacugauuuccagggaaucaugguccuacauuguagaaaaaccaaauccugagaauggaacauguuacccagggcauuucgccgacuaugaggaacugagggagcaauugaguucaguaucuucauuugagagauucgaaauauuucccaaagaaagcucauggcccaaccacaccacaaccggaguaucagcaucaugcucccauaauggggaaagcaguuuuuacaaaaauuugcuauggcugacggggaagaaugguuuguacccaaaccugagcaaguccuaugcaaacaacaaagagaaagaaguccuuguacuaugggguguucaucacccgccuaacauaggugaucaaagggcccucuaucauacagaaaaugcuuaugucucuguagugucuucacauuauagcagaaaauucaccccagaaauagccaaaagacccaaaguaagagaucaagaaggaagaaucaacuacuacuggacucuacuugagcccggggauacaauaauauuugaggcaaauggaaaucuaauagcgccaagauaugcuuucgcacugaguagaggcuuuggaucaggaaucaucaacucaaaugcaucaaugggugaaugugaugcgaagugccagacaccucagggagcuauaaacagcagucuuccuuuccagaauguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcagggaucuggcuaugcugcagaucaaaaaagcacacaaaaugccauuaaugggauuacaaacaaggugaauucuguaauugagaaaaugaacacucaauucacagcugugggcaaagaauucaacaaauuggaaagaaggauggaaaacuuaaauaaaaaaguugaugauggguuuauagacauuuggacauauaaugcagaauuguugguucuacuggaaaaugaaaggacuuuggauuuccaugacuccaaugugaagaaucuguaugagaaaguaaaaagccaauuaaagaauaaugccaaagaaauaggaaauggguguuuugaauucuaucacaaguguaaugaugaaugcauggagaguguaaaaaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33004 - RNA, 1698 nt, Artificial Sequence
  hemagglutinin__InfluenzaA__ACK99028
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaguaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccuaagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagccgugggcaaagaauucaacaaauuggaaagaaggauggaaaacuugaauaaaaaaguugaugauggguuuauagacaucuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33005 - RNA, 1698 nt, Artificial Sequence
  hemagglutinin__InfluenzaA__ACK99029
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucuucauucgagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauauccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33006 - RNA, 1698 nt, Artificial Sequence; identical to SEQ ID NO: 32997
  hemagglutinin__InfluenzaA__ACK99030

SEQ ID NO: 33007 - RNA, 1698 nt, Artificial Sequence; identical to SEQ ID NO: 32997
  hemagglutinin__InfluenzaA__ACK99031

SEQ ID NO: 33008 - RNA, 1698 nt, Artificial Sequence; identical to SEQ ID NO: 32997
  hemagglutinin__InfluenzaA__ACK99032

SEQ ID NO: 33009 - RNA, 1698 nt, Artificial Sequence
  hemagglutinin__InfluenzaA__ACK99033
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33010 - RNA, 1698 nt, Artificial Sequence
  hemagglutinin__InfluenzaA__ACK99034
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagagacuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33011 - RNA, 1698 nt, Artificial Sequence
  hemagglutinin__InfluenzaA__ACK99035
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugauuaugaggaacugagggagcaauugaguucaguaucugcauucgagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauauccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaauacaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33012 - RNA, 1701 nt, Artificial Sequence; identical to SEQ ID NO: 32842
  hemagglutinin__InfluenzaA__ACK99421

SEQ ID NO: 33013 - RNA, 1689 nt, Artificial Sequence
  hemagglutinin__InfluenzaA__ACK99432
auggccaucauuuaucucauacuccuguucacagcagugaggggggaccagauaugcauuggauaccaugccaauaauuccacagaaaagaucgacacaauucuagagcggaaugucacugugacucaugccaaggacauccuugagaagacccauaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccgagauacaguuuguguuacccaggcagcuucaaugacuaugaagaauugaaacaucuccucagcagcguaaaacauuucgagaaaguaaagauuuugcccaaagauagauggacacagcauacaacaacuggagguucaauggccugcgcggugucagguaaaccaucauucuucaggaacauggucuggcugacaacgaaaggaccaaauuauccgguugcccaaggaucguacaacaauacgagcggagaacaaaugcuaauaauuuggggagugcaccauccuaaugaugaggcagaacaaagagcauuguaccagaaagugggaaccuauguuuccgcaagcacaucaacauuguacaaaaggucaaucccagaaauagcagcaaggccuaaagugaauggacuaggaaguagaauggaauucucuuggacccucuuggauaugugggacaccauaaauuuugagagcacugguaaucuaguugcaccagaguauggguuuaaaauaucgaaaagagguaguucagggaucaugaagacagaaggaacacuugagaacugugaaaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagaaaagacuggagaacuugaacaaaaagauggaagacggguuucuagauguguggacauacaaugcagagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugacaaugaaugcauggauagugugaaaaacgggacauaugauuaucccaaguaugaagaagaaucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcagaaucugcauauga

SEQ ID NO: 33014 - RNA, 1701 nt, Artificial Sequence
  hemagglutinin__InfluenzaA__ACK99443
augaaagcaaaacuacuaguccuguuaugugcauuuacagcuacagaugcagacacaauauguauaggcuaccaugcgaacaacucaaccgacacuguugacacaguacuugagaagaacgugacagugacacacucugucaaccuacuugaggacagucacaacggaaaacuaugucgacuaaaaggaauagccccacuacaauuggguaauugcagcauugccggauggaucuuaggaaacccagaaugcgaaucacuguuuucuaaggaaucaugguccuacauugcagaaacaccaaacuccgagaauggaacauguuacccaggguauuucgccgacuaugaggaacugagggagcaauugaguucaguaucaucauucgagagauucgaaauauuccccaaagaaagcucauggcccaaccacaccguaaccaaaggaguaacggcagcaugcucccauaaugggaaaagcaguuuuuacagaaauuugcuauggcugacggagaagaauggcuuguacccaaaucugagcaaguccuauguaaacaacaaagagaaagaaguccuuguacuaugggguguucaucacccgucuaacauaggggaccaaagggccaucuaucauacagaaaaugcuuaugucucuguagugucuucacauuauagcaggagauucaccccagaaauagcaaaaagacccaaaguaagaggucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagucuuccuuuccagaauguacacccagucacaauaggagaguguccaaaguaugucaggaguacaaaauuaaggaugguuacaggacuaaggaacaucccauccguucaauccagagguuuguuuggagccauugccgguuucauugaagggggguggacuggaaugauagauggaugguaugguuaucaucaucaaaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaagaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaagccaauuaaagaauaaugccaaagaaauaggaaacggguguuuugaauucuaccacaaguguaacaaugaaugcauggaaagugugaaaaauggaacuuaugacuauccaaaauauuccgaggaaucaaaguuaaacagggaaaaaauugauggagugaaauuggaaucaaugggagucuaucagauucuggcgaucuacucaacugucgccaguucacuggugcuuuuggucucccugggggcaaucagcuucuggauguguucuaaugggucuuugcaguguagaauaugcaucuga

SEQ ID NO: 33015 - RNA, 1701 nt, Artificial Sequence
  hemagglutinin__InfluenzaA__ACK99465
augaaagcaaaacuacuaguccuguugugugcauuuacugcuacauaugcagacacaauauguauaggcuaccaugcgaacaacucaaccgacacuguugacacaguacuugagaagaacgugacagugacacacucugucaaccuacuugaggacagucacaacggaaaacuaugccgacuaaaaggaacagccccacuacaauuggguaauugcagcguugccggauggaucuuaggaaacccagaaugcgaaucacuguuuucuaaggaaucaugguccuacauugcagaaaaaccaaacccugagaauggaacauguuacccaggguauuucgccgacuaugaggaacugagggagcaauugagcucaguaucaucauucgagagauucgaaauauuccccaaggaaagcucauggcccaaccacacaguaaccaaaggagugacggcaucaugcucccauaaugggaaaagcaguuuuuacaaaaauuugcuauggcugacgaaaaagaauggcuuguacccaaaucugagcaaguccuauguaaacaacaaggagaaagaaguccuuguacuaugggguguucaucacccgucuaacauaggggaccaaagggccaucuaucauacagaaaaugcuuaugucucuguggugucuucacauuauagcagaagauucaccccagaaauagcaaaaagacccaaaguaagagaucaagaagggagaauuaacuacuacuggacucugcuggaacccggggacacaauaauauuugaggcaaauggaaaucuaauagcgccaugguacgcuuucgcacugaguagaggcuuugggucaggaaucaucaccucaaacgcaucaaugggugaaugugacgcuaagugucaaacaccccaaggagcuauaaacaguagucuuccuuuccagaauguacacccagucacaauaggagagugucccaaguaugucaggaguacaaaauuaaggaugguuacaggacuaagaaacaucccauccauucaaucuagagguuuguuuggagccauugccgguuucauugaagggggguggacuggaaugauagauggaugguaugguuaucaucaucagaaugaacaaggaucuggcuaugcugcagacaaaaaaagcacacaaaaugccauugaugggauuacaaacaaggugaauucuguaaucgagaaaaugaacacucaauucacagcuguaggcaaagaauucaacaaauuagagagaaggauggaaaacuuaaauaagaaaguugaugauggauuucuggacauuuggacauauaaugcagaguuguugguucuccuggaaaaugaaaggacuuuggauuuucaugacucaaaugugaagaaucuguaugagaaaguaaaaaaccaauugaagaauaaugccaaagaaaucgggaacggguguuuugaauucuaucacaaguguaacaaugaaugcauggaaagugugaaaaauggaacuuaugacuauccaaaauauuccgaagaaucaaaguuaaaaagggaaaaaauugauggagugaaauuggaaucaaugggagucuaucagauucuggcgaucuacucaacugucgccaguucacuggugcuuuuggucucccugggggcaaucaguuucuggauguguucuaaugggucuuugcaguguagaauaugcaucuga

SEQ ID NO: 33016 - RNA, 1701 nt, Artificial Sequence
  hemagglutinin__InfluenzaA__ACK99476
augaagacuaucauugcuuugagcuacauuuuauguaugguuuucgcucaaaaacuucccggaaaugacaacagcacggcaacgcugugccugggacaccaugcagugccaaacggaacgcuagugaaaacaaucacgaaugaccaaauugaagugacuaaugcuacugagcugguucagaguuccucaacagguagaauaugcgacaguccucaccgaauccuugauggaaaaaacugcacacugauagaugcucuauugggagacccucauugugaugacuuccaaaauaaggaaugggaccuuuuuguugaacgcagcaaagcuuacagcaacuguuacccuuaugaugugccggauuaugccucccuuaggucacuaguugccucauccggcacccuggaguuuaacaaugaaagcuucaauuggacuggagucgcucagaauggaacaagcuaugcuugcaaaaggagaucuguuaaaaguuucuuuaguagauugaauugguugcacaaauuagaauacaaauauccagcacugaacgugacuaugccaaacaaugacaaauuugacaaauuguacauuugggggguucaccacccgaggacggacagugaccaaaccagccuauauguucaagcaucagggagagucacagucucuaccaaaagaagccaacaaacuguaaucccgaauaucggaucuagccccuggguaaggggugucuccagcagaauaagcaucuauuggacaauaguaaaaccuggagacauacuuuugauuaacagcacagggaaucuaauugcuccucgggguuacuucaaaauacgaagugggaaaagcucaauaaugaggucagaugcacccauuggcaacugcaauucugaaugcaucacuccaaauggaagcauucccaaugacaaaccauuucaaaauguaaacaggaucacauauggggccugucccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucaaccaaaucaacgggaaacugaauagguuaaucgagaaaacgaacgagaaauuccaucaaaucgaaaaagaauucucagaaguagaagggagaauucaggaccucgagaaauauguugaagacacuaaaauagaucucuggucguacaacgcggagcuucuuguugcccuggagaaccaacauacaauugaucuaacugacucagaaaugaacaaacuguuugaaagaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucauguuuuuugcuuuguguuguuuugcugggguucaucaugugggccugccaaaaaggcaacauuaggugcaacauuugcauuuga

SEQ ID NO: 33017 - RNA, 1698 nt, Artificial Sequence; identical to SEQ ID NO: 32437
  hemagglutinin__InfluenzaA__ACL12063

SEQ ID NO: 33018 - RNA, 1701 nt, Artificial Sequence
  hemagglutinin__InfluenzaA__ACL12129
augaagacuaucauugcuuugagcuacauuuuaugucugguuuucgcucaaaaacuucccggaaaugacaacagcacagcaacgcugugccugggacaucaugcagugccaaacggaacgcuagugaaaacaaucacgaaugaucaaauugaagugacuaaugcuacugaguugguucagaguuccucaacagguagaauaugcggcaguccucaccgaauccuugauggaaaaaacugcacacugauagaugcucuauugggagacccucauugugauggcuuccaaaauaaggaaugggaccuuuuuguugaacgcagcaaagcuuacagcaacuguuacccuuaugaugugccggauuaugccucccuuaggucacuaguugccucaucaggcacccuggaguuuaucaaugaagacuucaauuggacuggagucgcucaggaugggggaagcuaugcuugcaaaagaggaucuguuaacaguuucuuuaguagauugaauugguugcacaaauuagaauacaaauauccagcgcugaacgugacuaugccaaacaauggcaaauuugacaaauuguacauuugggggguucaccacccgagcacggacagugaccaaaccagccuauauguucgagcaucagggagagucacagucucuaccaaaagaagccaacaaacuguaaccccgaauaucgggucuagacccuggguaaggggucaguccaguagaauaagcaucuauuggacaauaguaaaaccgggagacauacuuuugauugauagcacagggaaucuaauugcuccucgggguuacuucaaaauacgaaaugggaaaagcucaauaaugaggucagaugcacccauuggcaacugcaguucugaaugcaucacuccaaauggaagcauucccaaugacaaaccuuuucaaaauguaaacagaaucacauauggggccugccccagauauguuaagcaaaacacucugaaauuggcaacagggaugcggaauguaccagagaaacaaacuagaggcauauucggcgcaaucgcagguuucauagaaaaugguugggagggaaugguagacgguugguacgguuucaggcaucaaaauucugagggcacaggacaagcagcagaucuuaaaagcacucaagcagcaaucgaccaaaucaacgggaaacugaauagguuaaucgagaaaacgaacgagaaauuccagcaaaucgaaaaagaauucucagaaguagaagggagaauucaggaccucgagaaauauguugaagacacuaaaauagaucucuggucuuacaacgcggagcuucuuguugcccuggagaaccaacauacaauugaucuaacugacucagaaaugaacaaacuguuugaaaaaacaaggaagcaacugagggaaaaugcugaggacaugggcaaugguugcuucaaaauauaccacaaaugugacaaugccugcauagggucaaucagaaauggaacuuaugaccaugauguauacagagacgaagcauuaaacaaccgguuccagaucaaagguguugagcugaagucaggauacaaagauuggauccuauggauuuccuuugccauaucaugcuuuuugcuuuguguuguuuugcugggguucaucaugugggccugccaaaaaggcaacauuaggugcaacauuugcauuuga

SEQ ID NO: 33019 - RNA, 1701 nt, Artificial Sequence; identical to SEQ ID NO: 32860
  hemagglutinin__InfluenzaA__ACL12140

SEQ ID NO: 33020 - RNA, 1698 nt, Artificial Sequence; identical to SEQ ID NO: 32945
  hemagglutinin__InfluenzaA__ACL12151

SEQ ID NO: 33021 - RNA, 1701 nt, Artificial Sequence
  hemagglutinin__InfluenzaA__ACL12162
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33022 - RNA, 1701 nt, Artificial Sequence
  hemagglutinin__InfluenzaA__ACL12173
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucaaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggaucuuauggauuuccuuugccauaucauguuuuuugcuuuguguugcuuuguugggguucaucaugugggccugccaaaaaggcaacauuaggugcaacauuugcauuuga

SEQ ID NO: 33023 - RNA, 1701 nt, Artificial Sequence
  hemagglutinin__InfluenzaA__ACL12184
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuauaaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33024 - RNA, 1701 nt, Artificial Sequence; identical to SEQ ID NO: 33021
  hemagglutinin__InfluenzaA__ACL12195

SEQ ID NO: 33025 - RNA, 1701 nt, Artificial Sequence
  hemagglutinin__InfluenzaA__ACL12217
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacguacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33026 - RNA, 1701 nt, Artificial Sequence
  hemagglutinin__InfluenzaA__ACL12228
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauauuggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaaugggacuuaugaccacgauguauacagagaugaagcauuaaacaaccgguuccagaucaagggaguugagcugaagucaggguacaaagauuggauccuauggauuuccuuugccauaucauguuuuuugcuuugugucgcuuuguugggguucaucaugugggccugccaaaaaggcaacauuaggugcaacauuugcauuuga

SEQ ID NO: 33027 - RNA, 1701 nt, Artificial Sequence
  hemagglutinin__InfluenzaA__ACL12239
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33028 - RNA, 1701 nt, Artificial Sequence
  hemagglutinin__InfluenzaA__ACL12250
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugucucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugaaggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33029 - RNA, 1701 nt, Artificial Sequence
  hemagglutinin__InfluenzaA__ACL12261
augaaagcaaaacuacuaguccuguuaugugcauuuacagcuacagaugcagacacaauauguauaggcuaccaugcgaacaacucaaccgacacuguugacacaguacuugaaaagaacgugacagugacacauucugucaaccuacuugaggacagucacaacgggaaacuaugucgacuaaaaggaauagccccacuacaauuggguaauugcagcauugccggauggaucuuaggaaacccagaaugcgaaucacuguuuucuaagaaaucaugguccuacauugcagaaacaccaaacuccgagaauggaacauguuacccaggguauuucgccgacuaugaggaacugagagagcaauugagcucaguaucaucauucgagagauucgaaauauuccccaaagaaagcucauggcccaaccacaccguaaccaaaggaguaacggcagcaugcucccauaaggggagaagcaguuuuuacagaaauuugcuauggcugacggagaagaauggcuuguacccaaaucugagcaaguccuaugugaacaacaaagagaaagaaguccuuguacuaugggguguucaucacccgucuaacauaggggaccaaagggccaucuaucauacagaaaaugcuuaugucucuguagugucuucacauuauaacaggagauucaccccagaaauagcaaaaagacccaaagucagaggucaagaaggaagaauuaacuacuacuggacucugcuggaacccggggacacaauaauauuugaggcaaauggaaaucuaauagcgccaugguaugcuuucgcacugaguagaggcuuugggucaggaaucaucaccucaaacgcaucaauggaugaaugugacgcgaagugucaaacaccccagggagcuauaaacaguagccuuccuuuccagaauguacacccagucacaauaggagagugcccaaaguaugucaggaguacaaaauuaaggaugguuacaggacuaaggaacaucccauccauucaauccagaggucuguuuggagccauugccgguuucauugaagggggguggacuggaaugauagauggaugguaugguuaucaucaucagaaugaacaaggaucuggcuaugcugcggaucaaaaaagcacacaaaaugccauuaacgggauuacaaacaaggugaauucuguaaucgagaaaaugaacacucaauucacagcugugggcaaagaauucaacaaauuagaaaaaaggauggaaaacuuaaauaaaaaaguugaugauggauuucuggacauuuggacauauaaugcagaauuguugguucuacuggaaaaugaaaggacuuuggauuuucaugacucaaaugugaagaaucuguaugagaaaguaaaaaaccaauuaaagaauaaugccaaagaaauaggaaacggguguuuugaauucuaccacaaguguaacaaugaaugcauggaaagugugaaaaauggaacuuaugacuaucccaaauauuccgaggaaucaaaauuaaacagggaaaaaauugauggagugaaauuggaaucaaugggagucuaucagauucuggcgaucuacucaacggucgccaguucacuggugcuucuggucucccugggggcaaucagcuucuggauguguucuaaugggucuuugcaauguagaauaugcauuuga

SEQ ID NO: 33030 - RNA, 1689 nt, Artificial Sequence
  hemagglutinin__InfluenzaA__ACN32272
auggccaucauuuaucucauacuccuguucacagcagugaggggggaccagauaugcauuggauaccaugccaauaauuccacagaaaagaucgacacaauucuagagcggaaugucacugugacucaugccaaggacauccuugagaagacccauaacggaaagcuaugcaaacuaaacggaaucccuccacuugaacuaggggacuguagcauugccggauggcuccuuggaaauccagaaugugauaggcuucuaagggugccagaaugguccuauauaauggagaaagaaaacccgagauacaguuuguguuacccaggcagcuucaaugacuaugaagaauugaaacaucuccucagcagcguaaaacauuucgagaaaguaaagauuuugcccaaagauagauggacacagcauacaacaacuggagguucaauggccugcgcggugucagguaaaccaucauucuucaggaacauggucuggcugacaacgaaaggaccaaauuauccgguugcccaaggaucguacaacaauacgagcggagaacaaaugcuaauaauuuggggagugcaccauccuaaugaugaggcagaacaaagagcauuguaccagaacgugggaaccuauguuuccgcaagcacaucaacauuguacaaaaggucaaucccagaaauagcagcaaggccuaaagugaauggacuaggaaguagaauggaauucucuuggacccucuuggauaugugggacaccauaaauuuugagagcacugguaaucuaguugcaccagaguauggguuuaaaauaucgaaaagagguaguucagggaucaugaagacagaaggaacacuugagaacugugaaaccaaaugccaaacuccuuugggagcaauaaauacaacacuaccuuuucacaauguccacccacugacaauaggugaaugccccaaauauguaaaaucggagaaauuggucuuagcaacaggacuaaggaauguuccccagauugaaucaagaggauuguuuggggcaauagcugguuuuauagaaggaggauggcaaggaaugguugaugguugguauggauaccaucacagcaaugaccagggaucaggguaugcagcagacaaagaauccacucaaaaggcauuugauggaaucaccaacaagguaaauucugugauugaaaagaugaacacccaauuugaagcuguugggaaagaauucaguaacuuagagaaaagacuggagaacuugaacaaaaagauggaagacggguuucuagauguguggacauacaaugcagagcuucuaguucugauggaaaaugagaggacacuugacuuucaugauucuaaugucaagaaucuguaugauaaagucagaaugcagcugagagacaacgucaaagaacuaggaaauggauguuuugaauuuuaucacaaaugugacaaugaaugcauggauagugugaaaaacgggacauaugauuaucccaaguaugaagaagaaucuaaacuaaauagaaaugaaaucaaagggguaaaauugagcagcauggggguuuaucaaauccuugccauuuaugcuacaguagcagguucucugucacuggcaaucaugauggcugggaucucuuucuggaugugcuccaacgggucucugcagugcagaaucugcauauga

SEQ ID NO: 33031 - RNA, 1701 nt, Artificial Sequence
  hemagglutinin__InfluenzaA__ACN32283
augaagacuaucauugcuuugagcuacauucuaugucugguuuccgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugccugcauaaggagaucuaauaacaguuucuuuaguagacugaauugguugacccacuuaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccguuuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33032 - RNA, 1701 nt, Artificial Sequence
  hemagglutinin__InfluenzaA__ACN32474
augaagacuaucauugcuuugagcuacauucuaugucugguuuccgcucaaaaacuuccuggaaaugacaacagcacggcaacacugugccuugggcaccaugcaguaccaaacggaacgauagugaaaacaaucacgaaugaccaaauugaaguuacuaaugcuacugaacugguucagaguuccucaacaggugaaauaugcgacaguccucaucagguccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuauaccucccuuaggucacuaguugccucaucuggcacacuggaguuuaacaaugaaagcuucaauuggacuggagucacucaaaacggaacaagcucugcuugcauaaggagaucuaauaacaguuucuuuaguagacugaauugguugacccacuuaaaauucaaauacccagcauugaacaugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccaggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgagguauacagagaugaagcauuaaacaaccgguuccagaucaagggcguugagcugaagucaggauacaaagauuggauucuauggauuuccuuugccauaucauguuuuuugcuuuguguugcuuuguugggguucaucaugugggccugccaaaaaggcaacauuaggugcaacauuugcauuuga

SEQ ID NO: 33033 - RNA, 1698 nt, Artificial Sequence
  hemagglutinin__InfluenzaA__ACN32501
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacugugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucguuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuaugucucuguagugucuucacauuauagcagaaaauucaccccagaaauagccaaaagacccaaaguaagagaucaagaaggaagaaucaacuacuacuggacucugcuugaacccggggauacuauaauauuugaggcaaauggaaaucuaauagcgccaagauaugcuuucgcacugaguagaggcuuuggaucaggaaucaucaacucaaaugcuccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccaucaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacguuggauuuccaugacuccaaugugaagaaucuguaugagaaaguaaaaagccaguuaaagaauaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuagcgaucuacucaacagucgccaguucucugguucuuuuggucucccugggggcaaucagcuucuggauguguuccaaugggucuuugcaguguagaauaugcaucuaa

SEQ ID NO: 33034 - RNA, 1701 nt, Artificial Sequence
  hemagglutinin__InfluenzaA__ACN32534
augaagacuaucauugcuuugagcuacauuuuaugucugguuuucgcucaaaaacuucccggaaaugacaacagcacggcaacgcugugccuggggcaccaugcagugccaaacggaacgcuagugaaaacaaucacgaaugaccaaauugaaguaacuaaugcuacugagcugguucagaguuccucaacagguagaauaugcgacaguccucaccaaauccuugauggagaaaacugcacacuaauagaugcucuauugggagacccucauugugauggcuuccaaaacaaggaaugggaccuuuuuguugaacgcagcaaagccuacagcaacuguuacccuuaugaugugccggauuaugucucccuuaggucacuaguugccucaucaggcacgcuggaguuuaacaaugaaagcuucaauuggacuggagucgcucagaauggaacaagcucugcuugcaaaaggagauccgauaaaaguuucuuuaguagauugaauugguugcaccaauuaaaauacaaauauccagcacugaacgugacuaugccaaacaaugaaaaauuugacaaauuguacauuugggggguucaccacccggguacagacagugaccaaaucagccuauaugcucaagcaucagggagagucacagucucuaccaaaagaagccaacaaacuguaaucccgaauaucggaucuggacccuggguaaggggugucuccagcagaauaagcaucuauuggacaauaguaaaaccgggagacauacuuuugauuaacagcacagggaaucuaauugcuccucgggguuacuucaaaauacgaagugggaaaagcucaauaaugaggucagaugcacccauuggcaaaugcaauucugaaugcaucacuccaaauggaagcauucccaauggcaaaccauuucaaaauguaaacaggaucacauauggggccugucccagauauguuaagcaaaacacucugaaauuggcaacagggaugcggaaugugccagagaaacaaacuagaggcauauucggugcaaucgcgggcuucauagaaaaugguugggagggaaugauggacgguugguacgguuucaggcaucagaauucugagggcacagggcaagcagcagaucuuaaaagcacucaagcagcaaucaaccaaaucaacgggaaacugaauagguuaaucgagaaaacgaacgagaaauuccaucaaauugaaaaagaauucucagaaguagaagggagaauucaggaccucgagaaauaugucgaggacacuaaaauagaucucuggucguacaaugcggagcuucuuguugcccuggagaaccaacauacaauugaucuaacugacucagaaaugaacaaacuguuugaaagaacaaagaagcaacugagggaaaaugcugaggauaugggcaaugguuguuucaaaauauaccacaaaugugacaaugccugcauagggucaaucagaaauggaacuuaugaccaugauguauacagagacgaagcauugaacaaccgguuccagaucaaagguguugagcugaagucaggauacaaagauuggauccuauggauuuccuuugccauaucauguuuuuugcuuuguauuguuuuacugggguucaucaugugggccugccaaaaaggcaacauuaggugcaacauuugcauuuga

SEQ ID NO: 33035 - RNA, 1701 nt, Artificial Sequence
  hemagglutinin__InfluenzaA__ACN32545
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucauugugauggcuuccaaaauaagaaaugggaccuuuuuguugaacgcagcaaagccuacagcaacuguuacccuuaugaugugccggauuaugccucccuuaggucacuaauugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaaaaauuugacaaauuguauauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggaggauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33036 - RNA, 1698 nt, Artificial Sequence
  hemagglutinin__InfluenzaA__ACN32793
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcgaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcaaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 33037 - RNA, 1698 nt, Artificial Sequence
  hemagglutinin__InfluenzaA__ACN32804
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaggaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcauugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuguuuggagccauugccgguuucauugaagggggguggacuggaaugguagauggaugguaugguuaccaccaucagaaugagcaaggaucuggguaugcugcugaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacaaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 33038 - RNA, 1698 nt, Artificial Sequence
  hemagglutinin__InfluenzaA__ACN32815
augaaaguaaaacuacugguucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauuacugauuuccaaggaaucaugguccuacauuguagagacaccaaauccugagaauggaacauguuacccagggaauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgccuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagccuuccuuuccagaauguacacccagucacaauaggagaguguccaaaguaugucaggagugcaaaauuaagaaugguuacagggcuaaggaacaucccauccauucaauccagagguuuguuuggggccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaauguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 33039 - RNA, 1698 nt, Artificial Sequence; identical to SEQ ID NO: 32459
  hemagglutinin__InfluenzaA__ACN32826

SEQ ID NO: 33040 - RNA, 1701 nt, Artificial Sequence
  hemagglutinin__InfluenzaA__ACN32848
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuaguagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33041 - RNA, 1701 nt, Artificial Sequence
  hemagglutinin__InfluenzaA__ACN32870
augaagacuaucauugcuuugagcuacauucuaugucugguuuucgcucaaaaauuuccuggaaaugacaacagcacggcgacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucaaauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaaugugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33042 - RNA, 1701 nt, Artificial Sequence
  hemagglutinin__InfluenzaA__ACN32892
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33043 - RNA, 1701 nt, Artificial Sequence
  hemagglutinin__InfluenzaA__ACN32903
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucauuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33044 - RNA, 1701 nt, Artificial Sequence
  hemagglutinin__InfluenzaA__ACN32914
augaagacuaucauugcuuugagcuacauucuaugucuggcuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33045 - RNA, 1701 nt, Artificial Sequence
  hemagglutinin__InfluenzaA__ACN32925
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33046 - RNA, 1701 nt, Artificial Sequence
  hemagglutinin__InfluenzaA__ACN32936
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaauaaagaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33047 - RNA, 1701 nt, Artificial Sequence; identical to SEQ ID NO: 33021
  hemagglutinin__InfluenzaA__ACN32947

SEQ ID NO: 33048 - RNA, 1701 nt, Artificial Sequence
  hemagglutinin__InfluenzaA__ACN32958
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaccagauccuugauggagaaaacugcacacuaauagaugcucuauugggagacccucagugugauggcuuccaaaauaagaaaugggaccuuuuuguugaacgcaacaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33049 - RNA, 1701 nt, Artificial Sequence
  hemagglutinin__InfluenzaA__ACN32969
augaagacuaucauugcuuugagcuacauucuaugucugguuuccgcucaaaaacuuccuggaaaugacaacagcacggcaacacugugccuugggcaccaugcaguaccaaacggaacgauagugaaaacaaucacgaaugaccaaauugaaguuacuaaugcuacugagcugguucagaguuccucaacaggugaaauaugcgacaguccucaucagguccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagauccaauaacaguuucuuuaguagacugaauugguugacccacucaaaauucaaauacccagcauugaacgugacuaugccaaacaaugaagaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaacuacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgagguauacagagaugaagcauuaaacaaccgguuccagaucaagggcguugagcugaagucaggauacaaagauuggauccuauggauuuccuuugccauaucaugcuuuuugcuuuguguugcuuuguugggguucaucaugugggccugccaaaaaggcaacauuaggugcaacauuugcauuuga

SEQ ID NO: 33050 - RNA, 1701 nt, Artificial Sequence
  hemagglutinin__InfluenzaA__ACN32980
augaagacuaucauugcuuugagcuacauucuaugccugguuuucgcucaaaaacuuccuggaaaugacaacagcacugcaacgcugugccuugggcaccaugcaguaccaaacgggacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagcccacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaaaaacaguuucuuuaguagauugaauugguugacccacuuaaaauucaaauacccagcauugaacgugacuaugccaaacgaugaaaaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauauccccagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguuaacaggaucacauacggggccugucccagauauguuaagcaaaacacucugaaauuggcaacaggaaugcgaaauguaccagagaaacaaacuagaggcauauuuggcgcaaucgcggguuucauagaaaaugguugggagggaaugguggaugguugguacgguuucaggcaucaaaauucugagggaauaggacaagcagcagaucucaaaagcacucaagcagcaaucgaucaaaucaauggaaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcguaggaucaaucagaaauggaacuuaugaccacgauguauacagagaugaagcauuaaacaaccgguuccagaucaagggcguugagcugaagucaggauacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33051 - RNA, 1701 nt, Artificial Sequence; identical to SEQ ID NO: 33027
  hemagglutinin__InfluenzaA__ACN32991

SEQ ID NO: 33052 - RNA, 1701 nt, Artificial Sequence; identical to SEQ ID NO: 33027
  hemagglutinin__InfluenzaA__ACN33002

SEQ ID NO: 33053 - RNA, 1701 nt, Artificial Sequence
  hemagglutinin__InfluenzaA__ACN33013
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33054 - RNA, 1701 nt, Artificial Sequence
  hemagglutinin__InfluenzaA__ACN33035
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacguuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacccugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33055 - RNA, 1701 nt, Artificial Sequence
  hemagglutinin__InfluenzaA__ACN33046
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauuaaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33056 - RNA, 1701 nt, Artificial Sequence
  hemagglutinin__InfluenzaA__ACN33057
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucaucuggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacagacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33057 - RNA, 1701 nt, Artificial Sequence
  hemagglutinin__InfluenzaA__ACN33068
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaucacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33058 - RNA, 1701 nt, Artificial Sequence
  hemagglutinin__InfluenzaA__ACN33079
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuagaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33059 - RNA, 1698 nt, Artificial Sequence
  hemagglutinin__InfluenzaA__ACN33090
augaaaguaaaacuacugauucuguuauguacauuuacagcuacauaugcagacacaauauguauaggcuaccaugccaacaacucgaccgacacuguugacacaguacuugagaagaaugugacagugacacacucugucaaccuacuugaggacagucacaauggaaaacuaugucuacuaaaaggaauagccccacuacaauuggguaauugcagcguugccggauggaucuuaggaaacccagaaugcgaauugcugauuuccaaggaaucaugguccuacauuguagagacaccaaauccugagaauggaacauguuacccaggguauuucgccgacuaugaggagcugagagagcaauugaguucaguaucuucauuugagagguucgaaauauuccccaaagagagcucauggcccaaccacaccguaaccggaguaucagcaucaugcucccauaacgggaaaagcaguuuuuacagaaauuugcuauggcugacggggaagaaugguuuguauccaaaccugagcaaguccuaugcaaacaacaaagagaaagaaguccuuguacugugggguguucaucacccgucuaacauaggggaccaaagggcccucuaucauacagaaaaugcuuaugucucuguagugucuucacauuauagcagaagauucaccccagaaauagccaaaagacccaaggugagagaucaggaaggaagaaucaacuacuacuggacucugcuugaacccggggauacaauaauauuugaggcaaauggaaaucuaauagcgccaagguuugcuuucgcacugaguagaggcuuuggaucaggaaucaucaccucaaaugcaccaauggaugaaugugaugcgaaaugucaaacaccucagggagcuauaaacagcagucuuccuuuccagaauguacacccagucacaauaggagaguguccaaaguaugucaggaguacaaaauuaagaaugguuacaggacuaaggaacaucccauccauucaauccagagguuuauuuggagccauugccgguuucauugaagggggguggacuggaaugguagaugguugguaugguuaucaccaucagaaugagcaaggaucuggguaugcugcagaucaaaaaagcacacaaaaugccauuaacgggauuacaaacaaggugaauucuguaauugagaaaaugaacacucaauucacagcugugggcaaagaauucaacaaauuggaaagaaggauggaaaacuuaaauaaaaaaguugaugauggguuucuagacauuuggacauauaacgcagaauuguugguucuacuggaaaaugaaaggacuuuggacuuccaugacuccaacgugaagaaucuguaugagaaaguaaaaagccaauuaaagaauaaugccaaagaaauaggaaacggguguuuugaauucuaucacaaguguaacgaugaaugcauggagagugugaaaaauggaacuuaugacuauccaaaauauuccgaagaaucaaaguugaacagggagaaaauugauggagugaaauuggaaucaaugggagucuaucagauuuuggcgaucuacucaacagucgccaguucccugguucuuuuggucucccugggggcaaucagcuucuggauguguuccaaugggucuuugcaguguagaauaugcaucuaa

SEQ ID NO: 33060 - RNA, 1698 nt, Artificial Sequence; identical to SEQ ID NO: 32418
  hemagglutinin__InfluenzaA__ACN33101

SEQ ID NO: 33061 - RNA, 1701 nt, Artificial Sequence
  hemagglutinin__InfluenzaA__ACN33112
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33062 - RNA, 1698 nt, Artificial Sequence
  hemagglutinin__InfluenzaA__ACN33123
augaaaguaaaacuacugguccuguuaugcacauuuacagcuacauaugcagacacaauauguauaggcuaccaugcuaacaacucgaccgacacuguugacacaguacuugaaaagaaugugacagugacacacucugucaaccugcuugagaacagucacaauggaaaacuaugucuauuaaaaggaauagccccacuacaauuggguaauugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaagcaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucagaagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucaggcuaugcugcagaucaaaaaagcacacaaaaugccauuaaugggauuacaaacaaggugaauucuguaauugagaaaaugaacacucaauucacagcagugggcaaagaauucaacaaauuggaaagaaggauggaaaacuugaauaaaaaaguugaugauggguuuauagacauuuggacauauaaugcagaacuguugguucuacuggaaaaugaaaggacuuuggauuuccaugacuccaaugugaagaaucuguaugagaaaguaaaaagccaguuaaagaacaaugcuaaagaaauaggaaauggguguuuugaauucuaucacaaguguaacgaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33063 - RNA, 1698 nt, Artificial Sequence
  hemagglutinin__InfluenzaA__ACN33145
augaaaguaaaacuacugguccuguuaugcacauuuacagcuacauaugcagacacaauauguauaggcuaccaugcuaacaacucgaccgacacuguugacacaguacuugaaaagaaugugacagugacgcacucugucaaccugcuugagaacagucacaauggaaaacuaugucuauuaaaaggaauagccccacuacaauuggguaacugcagcguugccggguggaucuuaggaaacccagaaugcgaauuacugauuuccaaggagucaugguccuacauuguagaaaaaccaaauccugagaauggaacauguuacccagggcauuucgcugacuaugaggaacugagggagcaauugaguucaguaucuucauuugagagguucgaaauauuccccaaagaaagcucauggcccaaccacaccguaaccggagugucagcaucaugcucccauaauggggaaaguaguuuuuacagaaauuugcuauggcugacggggaagaaugguuuguacccaaaccugagcaaguccuaugcaaacaacaaagaaaaagaaguccuuguacuaugggguguucaucacccgccaaacauaggugaccaaaaggcccucuaucauacagaaaaugcuuauguuucuguagugucuucacauuauagcagaaaauucaccccagaaauagccaaaagacccaaaguaagagaucaagaaggaagaaucaacuacuacuggacucugcuugaacccggggauacaauaauauuugaggcaaauggaaaucuaauagcgccaagauaugcuuucgcacugaguagaggcuuuggaucaggaaucaucaacucaaaugcaccaauggauaaaugugaugcgaagugccaaacaccucagggagcuauaaacagcagucuuccuuuccagaacguacacccagucacaauaggagaguguccaaaguaugucaggagugcaaaauuaaggaugguuacaggacuaaggaacaucccauccauucaauccagagguuuguuuggagccauugccgguuucauugaagggggguggacuggaaugguagaugguugguaugguuaucaucaucagaaugagcaaggaucuggcuaugcugcagaucaaaaaagcacacaaaaugccauuaaugggauuacaaacaaggugaauucuguaauugagaaaaugaacacucaauucacagccgugggcaaagaauucaacaaauuggaaagaaggauggaaaacuugaauaaaaaaguugaugauggguuuauagacaucuggacauauaaugcagaacuguugguucuacuggaaaaugaaaggacuuuggauuuccaugacuccaaugugaagaaucuguaugagaaaguaaaaagccaguuaaagaauaaugcuaaagaaauaggaaauggguguuuugaauucuaucacaaguguaaugaugaaugcauggagaguguaaagaauggaacuuaugacuauccaaaauauuccgaagaaucaaaguuaaacagggagaaaauugauggagugaaauuggaaucaaugggagucuaucagauucuggcgaucuacucaacagucgccaguucucugguucuuuuggucucccugggggcaaucagcuucuggauguguuccaaugggucuuugcaguguagaauaugcaucuaa

SEQ ID NO: 33064 - RNA, 1701 nt, Artificial Sequence
  hemagglutinin__InfluenzaA__ACN33156
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccugguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagagggcaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33065 - RNA, 1701 nt, Artificial Sequence
  hemagglutinin__InfluenzaA__ACN33178
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaaguggaaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccauaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33066 - RNA, 1701 nt, Artificial Sequence
  hemagglutinin__InfluenzaA__ACN33189
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgaagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggagcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33067 - RNA, 1701 nt, Artificial Sequence
  hemagglutinin__InfluenzaA__ACN33200
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguagaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcagaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33068 - RNA, 1701 nt, Artificial Sequence
  hemagglutinin__InfluenzaA__ACN33211
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucagggagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacagaaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaagcaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33069 - RNA, 1698 nt, Artificial Sequence; identical to SEQ ID NO: 32577
  hemagglutinin__InfluenzaA__ACN42981

SEQ ID NO: 33070 - RNA, 1698 nt, Artificial Sequence; identical to SEQ ID NO: 32694
  hemagglutinin__InfluenzaA__ACN42992

SEQ ID NO: 33071 - RNA, 1701 nt, Artificial Sequence
  hemagglutinin__InfluenzaA__ACN43003
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauacuauggauuuccuuugccauaucauguuuuuugcuuuguguugcuuuguugggguucaucaugugggccugccaaaaaggcaacauuaggugcaacauuugcauuuga

SEQ ID NO: 33072 - RNA, 1701 nt, Artificial Sequence
  hemagglutinin__InfluenzaA__ACN43014
augaagacuaucauugcuuugagcuacauucuaugucugguuuucgcucaaaaauuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaauugggaccuuuuuguugaacgcagcaaagccuacagcaacuguuacccuuaugaugugccggauuaugccucccuuaggucacuaguugccucauccggcacacuggaguuuaacaaugaaagcuuuaauuggauuggagucacucaaaacggaacaagcucugcuugcauaaggagaucuaauaacaguuucuuuaguagauugaauugguugacccacucaaaauucaaauacccagcauugaacgugacuaugccaaacaaugaaaauuuugacaaauuguacauuugggggguucaccacccggguacggacaaugaccaaaucuuccuguaugcucaagcaucaggaagaaucacagucucuaccaaaagaagucaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaacugcaauucugaaugcaucacuccaaauggaagcauucccaaugacaaaccauuccaaaauguaaacaggaucacauacggguccugucccagauauguuaagcaaaacacucugaaauuggcaacagggaugcgaaauguaccagagaaacaaacuagaggcauauuuggcgcaaucgcugguuucauagaaaaugguugggagggaaugguggaugguugguacgguuucaggcaucaaaauucugagggaauaggacaagcagcugaucucaaaagcacucaagcagcaaucgaucaaaucaaugggaagcugaauagguugaucgggaaaaccaacgagaaauuccaucagauugaaaaagaauucucagaagucgaagggagaauucaggaccuugagaaauauguugaggacaccaaaauagaucucuggucauacaacgcggagcuucuuguugcccuggagaaccaacauacaauugaucuaacugauucagaaaugaacaaacuguuugaaaaaacaaagaagcaacugagggaaaaugcugaggauaugggcaaugguuguuucaaaaucuaccacaaaugugacaaugccugcauaggaucaaucagaaauggaacuuaugaccacgaugucuacagagaugaagcauuaaacaaccgguuccagaucaagggcguugagcugaagucaggauacaaagauuggauccuauggauuuccuuugccauaucauguuuuuugcuuugcauugcuuuguugggguucaucaugugggccugccaaaaaggcaacauuaggugcaacauuugcauuuga

SEQ ID NO: 33073 - RNA, 1701 nt, Artificial Sequence
  hemagglutinin__InfluenzaA__ACN43025
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguaugcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugccuuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga

SEQ ID NO: 33074 - RNA, 1701 nt, Artificial Sequence
  hemagglutinin__InfluenzaA__ACN43036
augaagacuaucauugcuuugagcuacauucuaugucugguuuucgcucaaaaacuuccuggaaaugacaacagcacggcaacgcugugccuugggcaccaugcaguaccaaacggaacgauagugaaaacaaucacgaaugaccaaauugaaguuacuaaugcuacugagcugguucagaguuccucaacaggugaaauaugcgacaguccucaucagauccuugauggagaaaacugcacacuaauagaugcucuauugggagacccucagugugauggcuuccaaaauaagaaaugggaccuuuuuguugaacgcagcaaagccuacagcaacuguuacccuuaugaugugccggauuaugccucccuuaggucacuaguugccucauccggcacacuggaguuuaacaaugaaagcuucaauuggacuggagucacucaaaacggaacaagcucugcuugcauaaggagaucuaauaacaguuucuuuaguagauugaauugguugacccacuuaaaauucaaauacccagcauugaacgugacuaugccaaacaaugaacaauuugacaaauuguacauuugggggguucaccacccggguacggacaaugaccaaaucuuccuguacgcucaagcaucaggaagaaucacagucucuaccaaaagaagccaacaaacuguaaucccgaauaucggaucuagacccagaguaaggaauaucccuagcagaauaagcaucuauuggacaauaguaaaaccgggagacauacuuuugauuaacagcacagggaaucuaauugcuccuagggguuacuucaaaauacgaagugggaaaagcucaauaaugagaucagaugcacccauuggcaaaugcaauucugaaugcaucacuccaaauggaagcauucccaaugacaaaccauuccaaaauguaaacaggaucacauacggggccugucccagauauguuaagcaaaacacucugaaauuggcaacagggaugcgaaauguaccagagaaacaaacuagaggcauauuuggcgcaaucgcggguuucauagaaaaugguugggagggaaugguggaugguugguacgguuucaggcaucaaaauucugagggaagaggacaagcagcagaucucaaaagcacucaagcagcaaucgaucaaaucaaugggaagcugaauagauugaucgggaaaaccaacgagaaauuccaucagauugaaaaagaauucucagaagucgaagggagaauucaggaccuugagaaauauguugaggacacuaaaauagaucucuggucauacaacgcggagcuucuuguugcccuggagaaccaacauacaauugaucuaacugacucagaaaugaacaaacuguuugaaaaaacaaagaagcaacugagggaaaaugcugaggauaugggcaaugguuguuucaaaauauaccacaaaugugacaaugccugcauaggaucaaucagaaauggaacuuaugaccacgauguauacagagaugaagcauuaaacaaccgguuccagaucaagggaguugagcugaagucaggguacaaagauuggauccuauggauuuccuuugccauaucauguuuuuugcuuuguguugcuuuguugggguucaucaugugggccugccaaaaaggcaacauuaggugcaacauuugcauuuga
